United States Patent 11,098,302 (IDENTIFICATION OF POLYNUCLEOTIDES ASSOCIATED WITH A SAMPLE) - sequence listing, part 129

SEQ ID NO: 452900 - DNA, 549 bp, Homo sapiens
  misc_feature: HEFZJCU01EUZ5V.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaaccaccctttatctgcaaatagacagcctgagaccagacgacacggctgtctattattgcgcgagagagacacaacgaacctactggccaatactagtgggggcttgttcgtggggccgacggggaccctgggtcatcgtcctccccacgccctccaaccaacggggcccacgtccggtccttcccccgtggcccgcccgtcg

SEQ ID NO: 452901 - DNA, 483 bp, Homo sapiens; identical to SEQ ID NO: 444924
  misc_feature: HEFZJCU01AK7NU.10.35.D02.1.454.heavy.3.raw

SEQ ID NO: 452902 - DNA, 480 bp, Homo sapiens; identical to SEQ ID NO: 446171
  misc_feature: HEFZJCU01DD45G.22.36.D03.1.454.heavy.3.raw

SEQ ID NO: 452903 - DNA, 417 bp, Homo sapiens
  misc_feature: HEFZJCU01ANGTJ.16.28.C06.1.454.heavy.3.raw
tgtactactccacgaccggtgctcgatttagagctcacgtattgggtttgggattgtctctggagtgggtctcacttattagtggtagtggtagtactacatactacgcagactccgtgaagggccggttcaccatctccagagacaatcccaagaacacgctgtatctgcaaatgaacggcctgagagccgaggacacggccgtatattactgtgcccgagggaggttttactatgatattactggttacaaaaagggtactactttgactactggggccagggaaccctggtcaccgtctcctcagcctccaccaagggcccatcggtcttccccctggcgccctgctccaggagcacctccgagaacacagcggccctgggctgcctggtcaaggactacttccgagtagtaca

SEQ ID NO: 452904 - DNA, 518 bp, Homo sapiens; identical to SEQ ID NO: 451152
  misc_feature: HEFZJCU01B76CT.13.76.G10.1.454.heavy.3.raw

SEQ ID NO: 452905 - DNA, 509 bp, Homo sapiens
  misc_feature: HEFZJCU01A5RBY.9.64.F09.1.454.heavy.3.raw
tgatacgtctcacgaccggtgctcgatttagcgcgtatacaaggggctcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttgggtccgccaggctccagggaagggcctggagtgggtggccaacataaaggaagatggaagtgagaagtcctatgtggactctgtgaagggccgattcatcatctccagagacaacgccgagaactccctgtatctgcaaatgaacagcctgagagtcgaggacacggctatgtattattgtgtgagagataaaaagtggggccagggaaccctggtcaccgtct

SEQ ID NO: 452906 - DNA, 497 bp, Homo sapiens
  misc_feature: HEFZJCU01D7TZ5.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctgggccgtggcacctgctgactgtctcctcagcctccaccaagggcccatcggtcttcccctggcgccctgctccaggagcacctccgagagcacagcggccctgggcctgcctggtcaaggactaccg

SEQ ID NO: 452907 - DNA, 500 bp, Homo sapiens
  misc_feature: HEFZJCU01BOJB6.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtctggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggac

SEQ ID NO: 452908 - DNA, 515 bp, Homo sapiens
  misc_feature: HEFZJCU01DNEB3.9.70.G04.1.454.heavy.3.raw
tgatacgtctcacgaccggtgctcgatttagtgtagtgtgaagggaaagggcctgtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctggggccaggggaccaaggtcaccgtctcctcagcctccaccaagggcccatcggtcttccccctggcgccctgctccaggagcacctccgagagcacagcggccctgggctgcctggtcaaggactacttccagacgtatca

SEQ ID NO: 452909 - DNA, 479 bp, Homo sapiens
  misc_feature: HEFZJCU01DFP30.40.83.H06.1.454.heavy.3.raw
  modified_base (348)..(348): a, c, t, g, unknown or other
tctagcgactcacgaccggtgctcgatttagatcacgtgcgtcgcgggggggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtcactgagactctcctgtgcatcgtccggattcaccttccataaatataacatgcactgggtccgccaggctccaggcaagggactgcagtggctggccactgtctggtcgatgaaagttntgcatactatgcagactctctggaggggccgattcatcatctctagagacaattcgaagaacacggcttatctgcaaatgaacagcctgacagtcgaggacacggctgtatatttctgtgcgaatgaggaa

SEQ ID NO: 452910 - DNA, 398 bp, Homo sapiens; identical to SEQ ID NO: 444524
  misc_feature: HEFZJCU01AZ0H3.7.60.F05.1.454.heavy.3.raw

SEQ ID NO: 452911 - DNA, 540 bp, Homo sapiens
  misc_feature: HEFZJCU01CMNYQ.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttaggactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacaagccgtggtattactgtaccgacactcccctgaaacgcgtcaactactactactacggtatggacctccg

SEQ ID NO: 452912 - DNA, 505 bp, Homo sapiens
  misc_feature: HEFZJCU01B75BO.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggccctgggctgcctggtcaaggactacttccgatagtaca

SEQ ID NO: 452913 - DNA, 527 bp, Homo sapiens
  misc_feature: HEFZJCU01D21AG.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaacccgtggtcaccgtctccccaccctccaccaagggcccatcggtcttcccctggcaccctcctccaagagcacctctgggggcacagcggccctgggctgcctggtcaaggactacttcccatactcgta

SEQ ID NO: 452914 - DNA, 519 bp, Homo sapiens
  misc_feature: HEFZJCU01AQGW2.48.65.F10.1.454.heavy.3.raw
agtatacatacacgaccggtgctcgatttagctacgctctaagggggtggctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttctatggtgggtccttcagtggttactactggagctggatccgccagcccccagggaaggggctggagtggattggggaaatcaatcatagtggaagcaccaactacaacccgtccctcaggagtcgagtcaccatatcagtagacacgtccaagaaccagttctccctgaagctgagctctgtgaccgccgcggacacggctgtgtattactgtgcgagagcggatattgtagtagtaccagctgctatttttgtccggtggttcgacccctggggccagggaccctggtcaccgtctcctcagcct

SEQ ID NO: 452915 - DNA, 498 bp, Homo sapiens; identical to SEQ ID NO: 445952
  misc_feature: HEFZJCU01CO04C.11.71.G05.1.454.heavy.3.raw

SEQ ID NO: 452916 - DNA, 520 bp, Homo sapiens; identical to SEQ ID NO: 446725
  misc_feature: HEFZJCU01DAN8F.12.86.H09.1.454.heavy.3.raw

SEQ ID NO: 452917 - DNA, 390 bp, Homo sapiens; identical to SEQ ID NO: 444541
  misc_feature: HEFZJCU01CYGCE.16.24.C02.1.454.heavy.3.raw

SEQ ID NO: 452918 - DNA, 499 bp, Homo sapiens; identical to SEQ ID NO: 447382
  misc_feature: HEFZJCU01D768N.11.73.G07.1.454.heavy.3.raw

SEQ ID NO: 452919 - DNA, 406 bp, Homo sapiens
  misc_feature: HEFZJCU01EDIR1.51.31.C09.1.454.heavy.3.raw
cgatcgtatacacgaccggtgctcgatttagacgtctcatcaaggaaggaaggggctggagtgggtctcaatgatcagtgatggtggaacgaccacaaactacgccgactccgtgaagggccggtgcaccatctccagagacaattcgaaggacactttatatctgcaactcaacagactgacacccgcggacacggccgtctactactgtgtgaaagaagacggaccgctggacgaggagccagaggagaatcactactttgactactgggccagggaagactggtcaccgtctcctccgcctccaccaaggcccatcggtcttccccctggcaccctcctccaagagcacctctggggcacagcgcctgggctgcctggtcaaggactacttcctcgtagcact

SEQ ID NO: 452920 - DNA, 519 bp, Homo sapiens
  misc_feature: HEFZJCU01C8FO3.52.22.B11.1.454.heavy.3.raw
  modified_base (450)..(450): a, c, t, g, unknown or other
cgcagtacgacacgaccggtgctcgatttagacgacagctcaggggctgggagaggagccccagccgtgagattcccaggagattccacttggtgatcagcactgaacacagacctccaaccatggagtttgggcttagctgcgttttccttgttgctattttaaaaggtgtccaatgtgaggtgcagctggttgagtctgggggaggcttggtacagccagggcggtccctgagactctcctgtgtaacctcaggattcatgtttggtgattatggaatgacctgggtccgccaggctccaggggagggcctggagtgggtagctttcgttagcagaaagactgaaggtgggacaacagaatcgccgcgtctgtgaaaggcagatttatcatctcaagagacgattccaaaggcatcgcctatctgcaaatgaacagcctgaaaaccgnggaacacagccgtgtatttttgtactagagtcttcttgtattactatgatactagtggttttacaggta

SEQ ID NO: 452921 - DNA, 480 bp, Homo sapiens
  misc_feature: HEFZJCU01DXWL1.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaaggcccatcggtcttcccctggcgcctgctccaggagcacctccgagagcacagcggcctggctgcctgtcaagactactcctacgtgagct

SEQ ID NO: 452922 - DNA, 495 bp, Homo sapiens
  misc_feature: HEFZJCU01AF6UO.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctgggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaatcctagtggc

SEQ ID NO: 452923 - DNA, 513 bp, Homo sapiens
  misc_feature: HEFZJCU01B3LU5.10.9.A09.1.454.heavy.3.raw
catagtagtgcacgaccggtgctcgatttagcgagacgcgcagggggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccgagcgggagttccaagtactcctttg

SEQ ID NO: 452924 - DNA, 490 bp, Homo sapiens
  misc_feature: HEFZJCU01C0O22.18.70.G04.1.454.heavy.3.raw
  modified_base (415)..(415): a, c, t, g, unknown or other
tacgagtatgcacgaccggtgctcgatttagtgtagtgtgaagggaaagggggaaggaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaaggcccatcggtcttcccctggcnccctgctccaggagcacctccgagagcacagcggccctgggctgcctggtcaaggactacttcccattactcgta

SEQ ID NO: 452925 - DNA, 515 bp, Homo sapiens
  misc_feature: HEFZJCU01AVJQ4.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtctcc

SEQ ID NO: 452926 - DNA, 445 bp, Homo sapiens; identical to SEQ ID NO: 445213
  misc_feature: HEFZJCU01AXQQQ.3.86.H09.1.454.heavy.3.raw

SEQ ID NO: 452927 - DNA, 510 bp, Homo sapiens
  misc_feature: HEFZJCU01DNVXB.48.33.C11.1.454.heavy.3.raw
agtatacatacacgaccggtgctcgatttagagtgagctcgttgggtttggggtttgggtgctgggcacggtgggcatgtgtgagttttgtcacaagatttgggctcaactctcctgtgcagcctctggattcacctttgatgattatgccatgcactgggtccggcaagttccagggaagggcctggagtgggtctcaggcattagtagaattaggggtagcatagcctatgcggattctgtgaagggccgattcaccatctccagagacaacgccaagaactccctgtatctgcaaatgaacagtctgagacctgaggacacggccttctattactgtgcaaaagatcaggcattagactacaacggtatggacgtctggggccagggatcacggtcaccgtctcctcagcctccaccaaggcccatcggtcttcccctggcaccctcctccaagagcacctctggggcacagcggccctgggctgcctggtccaggactacgttcct

SEQ ID NO: 452928 - DNA, 519 bp, Homo sapiens; identical to SEQ ID NO: 444867
  misc_feature: HEFZJCU01A1HGU.9.34.D01.1.454.heavy.3.raw

SEQ ID NO: 452929 - DNA, 501 bp, Homo sapiens; identical to SEQ ID NO: 445027
  misc_feature: HEFZJCU01CH3HU.26.23.C01.1.454.heavy.3.raw

SEQ ID NO: 452930 - DNA, 315 bp, Homo sapiens; identical to SEQ ID NO: 444763
  misc_feature: HEFZJCU01DL3TQ.47.56.F01.1.454.heavy.3.raw

SEQ ID NO: 452931 - DNA, 507 bp, Homo sapiens; identical to SEQ ID NO: 446095
  misc_feature: HEFZJCU01DPUJU.10.38.D05.1.454.heavy.3.raw

SEQ ID NO: 452932 - DNA, 504 bp, Homo sapiens
  misc_feature: HEFZJCU01CEAG0.9.33.C11.1.454.heavy.3.raw
tgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttccccctggcgccctgctccaggagcacctccgagagcacagcggccctgggctgcctggtcaaggactacttccagacgtatca

SEQ ID NO: 452933 - DNA, 496 bp, Homo sapiens
  misc_feature: HEFZJCU01A6X9W.53.81.H04.1.454.heavy.3.raw
cgcgtatacacacgaccggtgctcgatttagtagtgtagattcgcggggagctctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaagggactggagtgggtggcagttatatcatttgatggaagcactacatactacgcaaactccgtgaagggccgattcaccatctccagagacgattccaggaacactctgtttctccaaatgaacagcctgagagctgaggacacggctctttattactgtgcgagagattctggatacagcct

SEQ ID NO: 452934 - DNA, 508 bp, Homo sapiens; identical to SEQ ID NO: 445288
  misc_feature: HEFZJCU01DA0JD.51.43.D10.1.454.heavy.3.raw

SEQ ID NO: 452935 - DNA, 390 bp, Homo sapiens
  misc_feature: HEFZJCU01CD8PN.48.29.C07.1.454.heavy.3.raw
agtatacatacacgaccggtgctcgatttagagtgctacgaagggaaaggggctggacgggatctcgggaattagtgctgctagtggtagcagtttatacgcagactccgtgaagggccgattcaccatctccagagacaattccaagaacacggcgtatctgcagatgaacaacctgggcgtcgaggacacggccatttattactgtgcgaaatcctctggccgtgccgctaggtactttgagcactggggtccgggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 452936 - DNA, 512 bp, Homo sapiens
  misc_feature: HEFZJCU01ETYN8.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccgtccgggacagacttaccatgaccacgaactcctccataaacacagcctacatggagttgaggagcctgacatctgacgacacggccgtctattactgtgcgagagtcccacgatccggtgagcctacgggcaggccgggccctttggaccttcgtc

SEQ ID NO: 452937 - DNA, 499 bp, Homo sapiens; identical to SEQ ID NO: 446805
  misc_feature: HEFZJCU01DOMFA.3.20.B09.1.454.heavy.3.raw

SEQ ID NO: 452938 - DNA, 513 bp, Homo sapiens
  misc_feature: HEFZJCU01DH4GR.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtgggccgggaaccctggtcaccgtctcttcagctccaccaacgggcccatcggtcttccccctcggcaccctcctccaagacgcacctctggggc

SEQ ID NO: 452939 - DNA, 487 bp, Homo sapiens
  misc_feature: HEFZJCU01AWH38.12.53.E09.1.454.heavy.3.raw
atacgacgtacacgaccggtgctcgatttagagagagtgtgttgggtttggggggtccctgagactctcctgtgcagcctctcgattcagcttcagtaactatgctatgcactgggtccgccaggctccaggcagggggctggagtgggtggcagttatatcatatgatggaagacataaatactacgcagactccgtgaagggccgattcaccctctccagagacaattccaagaatacgctgtatatgcaaatgaacagcctgagacctgaggacacggctatgtattactgtgcgagaggaccattttggaatgcttattataccggaaacgcttttgatatttggggccaagggacaatggtcaccgtctcttcagcctccaccaagggcccatcggtcttcccctggcaccctcctccaagagcacctctgggggcacagcggccctgggctgcctggtcaggactacttcctacgtcgtat

SEQ ID NO: 452940 - DNA, 450 bp, Homo sapiens; identical to SEQ ID NO: 447469
  misc_feature: HEFZJCU01CSZZ5.52.5.A05.1.454.heavy.3.raw

SEQ ID NO: 452941 - DNA, 496 bp, Homo sapiens
  misc_feature: HEFZJCU01CIMLW.4.26.C04.1.454.heavy.3.raw
agcactgtagcacgaccggtgctcgatttagtctagcgactttgggtttggggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatctccagagacaattccaagaacacgttatatctgcaaatgaacagcctgcgagccgacgacacggccgtatattactgtgcgaaatgccttattgcgaccgagcgtagcagtggctggtgcaactggctcgaccctggggccagggaacccatgtcaccgtctcctcagcctccaccaagggcccatcggtcttcccctggcgccctgctccaggagcacctccgagaacacagcggccctgggctgcctggtcaaggactacttccctacagtgct

SEQ ID NO: 452942 - DNA, 493 bp, Homo sapiens
  misc_feature: HEFZJCU01EYDML.51.48.E04.1.454.heavy.3.raw
cgatcgtatacacgaccggtgctcgatttagagagcgtcacagagagaaggggtctgggagaggagcccagcactagaagtcggcggtgtttccattcggtgatcagcactgaacacagaggactcaccatggagtttgggctgagctgggttttcctcgctgctcttataagaggtgtccagtgtcaggtacaactggtggagtctgggggaggcgtggtccagcctgggaggtccctgagactctcctgtgcagcctctggattcactttcagaacttatgggatccactgggtccgccaggctccaggcaaggggctggagtgggtgtcacttatatcatatgatggaagaaacaaacattatgcagactccgtgcagggccgattcacaatctccagagacaattccaagaacacggtgtttttgcaatgaacagcctgagaggtgaggacacggctgtctattactgtgcgaaggagaagtattttca

SEQ ID NO: 452943 - DNA, 467 bp, Homo sapiens
  misc_feature: HEFZJCU01EGIUH.4.9.A09.1.454.heavy.3.raw
agcactgtagcacgaccggtgctcgatttagcgagacgcgcagggggattcacttttaccaaccatgccatgagctgggtccgccaggctccagggaaggggctggagtgggtctcaggcattagtggaattggtcgtgccacatactacgcagactccgtgaagggccgattcaccatctccagagacaattccaagaacacagtgtatctgcaaatgaacagcctgagagccgaggacacggccgtatattattgtgcgaacctaggaacgtcctattacgagattatgactggtcacggtgtcggtggctactttgacttctggggccagggaactatggtcaccgtctcgtcagcctccaccaagggcccatcggtcttccccctggcaccctcctccaagagcacctctgggggcacagcggccctgggctgcctggtcaaggactacttccctacagtgct

SEQ ID NO: 452944 - DNA, 532 bp, Homo sapiens
  misc_feature: HEFZJCU01BC0Z6.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgcaaactggttcgaccctggggcccgggaaccctggtcaccgtctcctcagcctccaccaagggcccatcggtcttcccctc

SEQ ID NO: 452945 - DNA, 480 bp, Homo sapiens
  misc_feature: HEFZJCU01BIAWX.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtggaagggactgctggggccagggagcccttgtcaccgtctcctcagcctccaccaagggcccatcggtcttcccctgcgccctgctccagagcacctccgagagcacagcggccctgggctgcctggtcaaggactacttcccactactatg

SEQ ID NO: 452946 - DNA, 506 bp, Homo sapiens
  misc_feature: HEFZJCU01C2QJK.9.12.B01.1.454.heavy.3.raw
tgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctattttaaaggtgtccagtgtgaggtgcagctggtggagtctgggggaggcttggtccagcctggggggtccctgaaactctcctgtgcagcctctggatacaccgtcagtagtaactccatgaactgggtccgccaggctccagggaaggggctggagtgggtctcagttatttatagcggtggtaacacatactacgcagactccgtgaagggcagattcaccatctccagagacaattccaggaacacgctgtatcttcaatgaacagcctgagagtcgaggacacggctgtatattactgtgcgagagatgtgtacgcttttgatatctgggaccg

SEQ ID NO: 452947 - DNA, 391 bp, Homo sapiens; identical to SEQ ID NO: 448048
  misc_feature: HEFZJCU01ARSCK.40.30.C08.1.454.heavy.3.raw

SEQ ID NO: 452948 - DNA, 518 bp, Homo sapiens; identical to SEQ ID NO: 444718
  misc_feature: HEFZJCU01E0IZY.9.34.D01.1.454.heavy.3.raw

SEQ ID NO: 452949 - DNA, 498 bp, Homo sapiens
  misc_feature: HEFZJCU01EHKDW.49.23.C01.1.454.heavy.3.raw
agtcgagagacacgaccggtgctcgatttagtacacgtgattagggattggggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactggggccagggaaccctggtcaccgtctcctcagcctccaccaagggcccatcggtcttcccctggcaccctcctccaagagcacctctgggggcacagcggccctgggctgcctggtcaggactacttcctctctcgact

SEQ ID NO: 452950 - DNA, 496 bp, Homo sapiens
  misc_feature: HEFZJCU01DDM51.51.78.H01.1.454.heavy.3.raw
cgatcgtatacacgaccggtgctcgatttagtgtgagtagtttgggtttgggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 452951 - DNA, 525 bp, Homo sapiens; identical to SEQ ID NO: 445545
  misc_feature: HEFZJCU01C7OUY.12.86.H09.1.454.heavy.3.raw

SEQ ID NO: 452952 - DNA, 390 bp, Homo sapiens; identical to SEQ ID NO: 444541
  misc_feature: HEFZJCU01ADWNR.16.24.C02.1.454.heavy.3.raw

SEQ ID NO: 452953 - DNA, 476 bp, Homo sapiens
  misc_feature: HEFZJCU01DIDOE.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccgagtataca

SEQ ID NO: 452954 - DNA, 495 bp, Homo sapiens
  misc_feature: HEFZJCU01C5JKD.4.7.A07.1.454.heavy.3.raw
  modified_base (449)..(449): a, c, t, g, unknown or other
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggcttttctgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaaagaacacgctgtatctgcaattgaacagcctgagagccgaggaacncggccgtatattactgtgcgaaagatttaggggaatggaccacgtc

SEQ ID NO: 452955 - DNA, 481 bp, Homo sapiens
  misc_feature: HEFZJCU01EAT4Z.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaaggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggactacttcctagagacacg

SEQ ID NO: 452956 - DNA, 403 bp, Homo sapiens; identical to SEQ ID NO: 444658
  misc_feature: HEFZJCU01EEVOP.14.60.F05.1.454.heavy.3.raw

SEQ ID NO: 452957 - DNA, 487 bp, Homo sapiens; identical to SEQ ID NO: 445219
  misc_feature: HEFZJCU01EFR0H.10.85.H08.1.454.heavy.3.raw

SEQ ID NO: 452958 - DNA, 427 bp, Homo sapiens; identical to SEQ ID NO: 449549
  misc_feature: HEFZJCU01BR79N.11.26.C04.1.454.heavy.3.raw

SEQ ID NO: 452959 - DNA, 509 bp, Homo sapiens
  misc_feature: HEFZJCU01CLL7W.2.33.C11.1.454.heavy.3.raw
acgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaatgaacagcctggaagacgcggacacagccatgtattattgtacattaggacactatagtccctggggccagggaaccctcg

SEQ ID NO: 452960 - DNA, 395 bp, Homo sapiens
  misc_feature: HEFZJCU01A65E3.47.45.E01.1.454.heavy.3.raw
agctcacgtacacgaccggtgctcgatttagtgagtcagtaagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctagcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 452961 - DNA, 501 bp, Homo sapiens; identical to SEQ ID NO: 445341
  misc_feature: HEFZJCU01AX6YE.48.34.D01.1.454.heavy.3.raw

SEQ ID NO: 452962 - DNA, 484 bp, Homo sapiens; identical to SEQ ID NO: 446564
  misc_feature: HEFZJCU01C9L02.19.13.B02.1.454.heavy.3.raw

SEQ ID NO: 452963 - DNA, 530 bp, Homo sapiens
  misc_feature: HEFZJCU01DF3I0.52.53.E09.1.454.heavy.3.raw
cgcagtacgacacgaccggtgctcgatttagagagagtgtgttgggtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttcccctggcaccctcctccaagagcacctctgggggcacagcggccctggg

SEQ ID NO: 452964 - DNA, 400 bp, Homo sapiens; identical to SEQ ID NO: 444452
  misc_feature: HEFZJCU01BPSEL.47.24.C02.1.454.heavy.3.raw

SEQ ID NO: 452965 - DNA, 509 bp, Homo sapiens
  misc_feature: HEFZJCU01EZ50P.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaaggggacgtgacatctgacgacacggccatgtattattgtgcgagagaaatgttaggtactgctttgggtccctggggcccgggaacccggggtc

SEQ ID NO: 452966 - DNA, 400 bp, Homo sapiens; identical to SEQ ID NO: 444452
  misc_feature: HEFZJCU01BKY0H.47.24.C02.1.454.heavy.3.raw

SEQ ID NO: 452967 - DNA, 521 bp, Homo sapiens
  misc_feature: HEFZJCU01BRI5P.40.67.G01.1.454.heavy.3.raw
tctagcgactcacgaccggtgctcgatttagagtatacatattgggtttgggggctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatggcgctcccactacagtgcggccctccagagtcgagccctcatatccatagacacgtccaagaaccagttttccctgacgctgacgtctgtgaccgccgcagacacggctgtctattattgtgcgagactagccttctgtagtgggggtacttgcaacccgggatactactccaccttcggcttggacatctggggccgaggggcctc

SEQ ID NO: 452968 - DNA, 532 bp, Homo sapiens
  misc_feature: HEFZJCU01BZENH.12.12.B01.1.454.heavy.3.raw
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtggattgggagtatctattttagcgggagcacctaccagaacgcgtccctcaagagtcgaatcaccatgtcggtggacacatcgaagaaccagatctcccttaagttgaggtctgtgaccgccgctgacacggccgtctattactgtgcgagagtccgtgctggaagaacacttttttgactattggggccagggaatcctggtcaccgtcgcctcagcctccaccaagggcccatcggtcttcccccg

SEQ ID NO: 452969 - DNA, 533 bp, Homo sapiens
  misc_feature: HEFZJCU01C769L.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattgggccgaggagcctggtcaccg

SEQ ID NO: 452970 - DNA, 500 bp, Homo sapiens
  misc_feature: HEFZJCU01CGVRH.13.55.E11.1.454.heavy.3.raw
tcacgtactacacgaccggtgctcgatttagcactcgcacgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattatgtgcaaaagatccaaccccttacgtt

SEQ ID NO: 452971 - DNA, 522 bp, Homo sapiens
  misc_feature: HEFZJCU01C4HZO.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaatacgcacagaggttccagggcagagtcaccattaccgcggacgaggccacgaagacagtctacatggaattgagcagcctgagatttgacgacacggccatgtattactgtgcgagggagggccagcctgctgggagcgtctacgatatttcgacccctggggccgagggaacccaggtcaccggtctcctcagcctccaccaagggcccatccgtcttcccctggcgccctgctccaggagcacctccgagagcacagcgccctgggctgcctggtcaggactacttcctacg

SEQ ID NO: 452972 - DNA, 533 bp, Homo sapiens
  misc_feature: HEFZJCU01BW177.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatccctgaaagcgtcaactactactactacggtatggacctctggggccg

SEQ ID NO: 452973 - DNA, 485 bp, Homo sapiens; identical to SEQ ID NO: 444908
  misc_feature: HEFZJCU01CONR3.12.40.D07.1.454.heavy.3.raw

SEQ ID NO: 452974 - DNA, 521 bp, Homo sapiens; identical to SEQ ID NO: 450748
  misc_feature: HEFZJCU01A88D4.12.40.D07.1.454.heavy.3.raw

SEQ ID NO: 452975 - DNA, 464 bp, Homo sapiens
  misc_feature: HEFZJCU01BOVIZ.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcggcagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggcccatcggtcttcccctggcgccctgctccaggagcacctccgagagcacagcggccctgggctgcctggtcaaggactacttcccacgagagta

SEQ ID NO: 452976 - DNA, 483 bp, Homo sapiens; identical to SEQ ID NO: 444639
  misc_feature: HEFZJCU01C8PMH.11.23.C01.1.454.heavy.3.raw

SEQ ID NO: 452977 - DNA, 496 bp, Homo sapiens
  misc_feature: HEFZJCU01AKUKB.49.82.H05.1.454.heavy.3.raw
agtcgagagacacgaccggtgctcgatttagtcgagctctctcgcgggagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggattcagcttcagtagttatgagatgaactgggtccgccaggctccagggaagggactggagtgggtttcatacattagtcggagagtcaacaccgtattctacacagactctgtgaggggccgattcaccatctccagagacaacgccaagaactcactgtatctccaaatgaacagcctgagagtcgaggacacggctgtctattactgtgcgagagatcccaacagcggctggtactttg

SEQ ID NO: 452978 - DNA, 463 bp, Homo sapiens; identical to SEQ ID NO: 446208
  misc_feature: HEFZJCU01CO559.19.10.A10.1.454.heavy.3.raw

SEQ ID NO: 452979 - DNA, 505 bp, Homo sapiens; identical to SEQ ID NO: 444759
  misc_feature: HEFZJCU01BE9GI.10.38.D05.1.454.heavy.3.raw

SEQ ID NO: 452980 - DNA, 393 bp, Homo sapiens; identical to SEQ ID NO: 444509
  misc_feature: HEFZJCU01C81LU.49.46.E02.1.454.heavy.3.raw

SEQ ID NO: 452981 - DNA, 501 bp, Homo sapiens
  misc_feature: HEFZJCU01BC937.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacgacaatttattactgtgcgagggtttatgtgttggaacgtggtacaccggaaaactggttcgacccctggggccagggaaccctggtcgtcgtctcgtctgcctccaccaagggcccatcggtcttcccctggcgccctgctccaggagcacctccgagagcacagccggccctgggctgacctggtcaggactacttcctagtacgtga

SEQ ID NO: 452982 - DNA, 499 bp, Homo sapiens
  misc_feature: HEFZJCU01AE7H8.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaggtgacgtacgggggcgttcg

SEQ ID NO: 452983 - DNA, 446 bp, Homo sapiens; identical to SEQ ID NO: 445556
  misc_feature: HEFZJCU01BY8PT.51.38.D05.1.454.heavy.3.raw

SEQ ID NO: 452984 - DNA, 538 bp, Homo sapiens
  misc_feature: HEFZJCU01AOYAU.52.49.E05.1.454.heavy.3.raw
cgcagtacgacacgaccggtgctcgatttagagcgactagcaacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccggacaagggcttgagtggatgggatggatcagcggtgacaacggcaacacaaattatggacagaagttccagggcagagtcaccatgaccgcggacacatccacgaacacagcctacatggagctgaggagcctaagatctgacgacacggccgtttattactgtgtgagagattttagggacctcggcccttgggggagttagtcgttactttgactactggggccagggacccaggtcaccgtctcc

SEQ ID NO: 452985 - DNA, 518 bp, Homo sapiens; identical to SEQ ID NO: 445423
  misc_feature: HEFZJCU01C4YJ3.7.78.H01.1.454.heavy.3.raw

SEQ ID NO: 452986 - DNA, 530 bp, Homo sapiens
  misc_feature: HEFZJCU01EXX2B.49.42.D09.1.454.heavy.3.raw
agtcgagagacacgaccggtgctcgatttagacacatacgcagggaaaggggggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcagtagtaattactactggggctgggtccgccagcccccagggaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggccatcggtcttccccctgg

SEQ ID NO: 452987 - DNA, 526 bp, Homo sapiens; identical to SEQ ID NO: 446836
  misc_feature: HEFZJCU01CXG9C.11.25.C03.1.454.heavy.3.raw

SEQ ID NO: 452988 - DNA, 495 bp, Homo sapiens; identical to SEQ ID NO: 445359
  misc_feature: HEFZJCU01D08QP.4.21.B10.1.454.heavy.3.raw

SEQ ID NO: 452989 - DNA, 511 bp, Homo sapiens
  misc_feature: HEFZJCU01DICHF.12.55.E11.1.454.heavy.3.raw
atacgacgtacacgaccggtgctcgatttagcactcgcacgttgggtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctgggccgtggcaccctggtcactgtctcctcggcttccaccaaggcccatcggtcttcccctggcgccctgctccaggagcacctcg

SEQ ID NO: 452990 - DNA, 529 bp, Homo sapiens
  misc_feature: HEFZJCU01EYNDH.52.27.C05.1.454.heavy.3.raw
cgcagtacgacacgaccggtgctcgatttagacgcgatcgaagggtttgggggctttctgagagtcatggacctcctgtgcaagaacatgaagcacctgtggttcttcctcctgctggtggcggctcccagatgggtcctgtcccagctgcagctgcaagagtcgggcccacgactggtgaagcctgcggagcccctgtccctcacctgcactgtctctggtgactccatcaccaataatgattactactgggcctggatccgccagcccccagggaaggggctggagtggattggcagtatattttatactggaaatacctaccaaaacccgtccctcaacagccgactcaccatttcagtggacacgtccaagaaccagttctccctgaaactgagctctgtgaccgccgcagacacggccatttattactgtgcgggagagaggcacaagactggagttcccgggagctggttcggctcctgggggccagggggaccccggtcaccgtctcctcagcctccaaccg

SEQ ID NO: 452991 - DNA, 491 bp, Homo sapiens; identical to SEQ ID NO: 451549
  misc_feature: HEFZJCU01BLZCI.49.17.B06.1.454.heavy.3.raw

SEQ ID NO: 452992 - DNA, 506 bp, Homo sapiens
  misc_feature: HEFZJCU01AMRC9.48.66.F11.1.454.heavy.3.raw
agtatacatacacgaccggtgctcgatttagtcacgcgagaaggggaaaggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtctaccg

SEQ ID NO: 452993 - DNA, 315 bp, Homo sapiens
  misc_feature: HEFZJCU01CTJCK.47.56.F01.1.454.heavy.3.raw
agctcacgtacacgaccggtgctcgatttagcagacgtctggtcgcggggccgattcaccgtctcagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctggggcacagcggccctgggctgcctggtcaaggactacttcctacgtgagct

SEQ ID NO: 452994 - DNA, 484 bp, Homo sapiens
  misc_feature: HEFZJCU01BDWTL.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaaggagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggactacttccgtatctctcg

SEQ ID NO: 452995 - DNA, 503 bp, Homo sapiens
  misc_feature: HEFZJCU01CJK5Y.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccagatccggtgagcctacggcaggcggcctttgacttctc

SEQ ID NO: 452996 - DNA, 521 bp, Homo sapiens
  misc_feature: HEFZJCU01BSEID.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaaggacacagccgtctattactgtgttaggggtagttttacgtatttttggtagtggagtatttaa

SEQ ID NO: 452997 - DNA, 538 bp, Homo sapiens
  misc_feature: HEFZJCU01DN8WH.48.3.A03.1.454.heavy.3.raw
agtatacatacacgaccggtgctcgatttagagagcgtcacaggggagctctgagagaggagcccagccctgggattttcaggtgttttcacttggtgatcaggactgaacagagagaactcaccatggagtttgggctgagctggctttttcttctggccattttaaaaggtgtccagtgtgaggagcagttgtcggaatctgggggagacctggtacagccgggggggtccctgacactctcctgtgtggcctctggattcatttttatcaaccacgccattacctgggtccgccagagtccagggaagggactggacggagtcgcgggtataagtggttttagtggaagtagattatacgcagagtccgtaaggggccggttcaccatctccagagacaattccaagaacacggcatatctacaaatgaacaacctgggcgccgaagacacggccgtctattactgtgcgagatcctctactagtgccgcgaggtactttgaactctggggtcagggaaccctgggtcaccgtct

SEQ ID NO: 452998 - DNA, 489 bp, Homo sapiens
  misc_feature: HEFZJCU01AIKN0.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttccccctggcgccctgctccaggagcacctccgagagcacagcggccctgggctgcctggtcaggactacttcccatactcgta

SEQ ID NO: 452999 - DNA, 518 bp, Homo sapiens
  misc_feature: HEFZJCU01EC3D7.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggccaccctcctccaagagcacctctgggggcacagcggcctgggctgcctggtcaggactactccgagtagtacac

SEQ ID NO: 453000 - DNA, 530 bp, Homo sapiens
  misc_feature: HEFZJCU01A3WTH.17.34.D01.1.454.heavy.3.raw
cgtagactagcacgaccggtgctcgatttagatcgtctgtgttgggtttggggacaaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctccttgacttctggggccatggaaccccggtcaccgt

SEQ ID NO: 453001 - DNA, 502 bp, Homo sapiens; identical to SEQ ID NO: 450016
  misc_feature: HEFZJCU01CA3EX.17.10.A10.1.454.heavy.3.raw

SEQ ID NO: 453002 - DNA, 482 bp, Homo sapiens; identical to SEQ ID NO: 444503
  misc_feature: HEFZJCU01ENPS7.7.10.A10.1.454.heavy.3.raw

SEQ ID NO: 453003 - DNA, 478 bp, Homo sapiens
  misc_feature: HEFZJCU01BWY7E.49.85.H08.1.454.heavy.3.raw
agtcgagagacacgaccggtgctcgatttagtatcactcagtcgcggggtctcagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggattcagcttcagtagttatgagatgaactgggtccgccaggctccagggaagggactggagtgggtttcatacattagtcggagagtcaacaccgtattctacacagactctgtgaggggccgattcaccatctccagagacaacgccaagaactcactgtatctccaaatgaacagcctgagagtcgaggacacggctgtctattactgtgcgagaga

SEQ ID NO: 453004 - DNA, 492 bp, Homo sapiens
  misc_feature: HEFZJCU01EBEY4.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcagggccctcccacatcggttatttctttgacttcctggggccagggaaccctggtcaccgtctcctc

SEQ ID NO: 453005 - DNA, 503 bp, Homo sapiens
  misc_feature: HEFZJCU01DE0R1.48.44.D11.1.454.heavy.3.raw
agtatacatacacgaccggtgctcgatttagcgcagtacgaaggggaggcttggtccagcctgggggtccctgaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaggcccatcggtcttcccctggcgccctgctccaggagcacctccgagagcacagcggccctgggctgcctggtcaaggactacttcctatgtatact

SEQ ID NO: 453006 - DNA, 534 bp, Homo sapiens
  misc_feature: HEFZJCU01DU0SH.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtatggctgtgtttatggggccagggagccctggtctaccg

SEQ ID NO: 453007 - DNA, 513 bp, Homo sapiens
  misc_feature: HEFZJCU01CLB7Z.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctatttgactactggggccaggggaactctggtcaccgtctccgcagcctcaccaagggcccc

SEQ ID NO: 453008 - DNA, 502 bp, Homo sapiens; identical to SEQ ID NO: 451203
  misc_feature: HEFZJCU01A7T4Q.10.38.D05.1.454.heavy.3.raw

SEQ ID NO: 453009 - DNA, 505 bp, Homo sapiens; identical to SEQ ID NO: 447076
  misc_feature: HEFZJCU01A3PIF.10.38.D05.1.454.heavy.3.raw

SEQ ID NO: 453010 - DNA, 501 bp, Homo sapiens; identical to SEQ ID NO: 445027
  misc_feature: HEFZJCU01BRII3.26.23.C01.1.454.heavy.3.raw

SEQ ID NO: 453011 - DNA, 511 bp, Homo sapiens
  misc_feature: HEFZJCU01DDWAZ.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactgggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 453012 - DNA, 505 bp, Homo sapiens
  misc_feature: HEFZJCU01CSQH7.14.78.H01.1.454.heavy.3.raw
cgtctagtaccacgaccggtgctcgatttagtgtgagtagtttgggtttgggggaggcttggtcaagcctggagggtccctgagactcttctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcatgttttagaagttggggcttttgaccactggggccagggaaccctggtcaccgtctcttcagcctccaccaaggcccatcggtcttcccctggcaccctcctccaagagcacctctgggggcacagcggccctgggctgcctggtcaaggactacttccgtactagacg

SEQ ID NO: 453013 - DNA, 496 bp, Homo sapiens; identical to SEQ ID NO: 446592
  misc_feature: HEFZJCU01AVAWP.4.75.G09.1.454.heavy.3.raw

SEQ ID NO: 453014 - DNA, 523 bp, Homo sapiens
  misc_feature: HEFZJCU01DU0HD.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttgggccagggaaccctggtcaccgtctcctcagcctccaccaagggcccatcggtcttcccctggcgccctgctccaggagcacctccgagagcacagcggccctggctgcctggtcaaggactacttcca

SEQ ID NO: 453015 - DNA, 503 bp, Homo sapiens
  misc_feature: HEFZJCU01CS7TE.48.53.E09.1.454.heavy.3.raw
agtatacatacacgaccggtgctcgatttagagagagtgtgttgggtttgggggctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttcgacccctggggccagggga

SEQ ID NO: 453016 - DNA, 508 bp, Homo sapiens
  misc_feature: HEFZJCU01D0JZ0.52.26.C04.1.454.heavy.3.raw
cgcagtacgacacgaccggtgctcgatttagtctagcgactttgggtttggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaaggtttgagtggatgggatggatcaccgctggcaatggtgacacaaaatattcacagaagttccagggcagagtcaccattaacagggacacatctgcgagtacaggctacatggaactgagcggcctgagatctgaggacacggctatttattactgtgcgagagggaagtgggatattgtggcagctccaggtgcccgagccggcccctactttcg

SEQ ID NO: 453017 - DNA, 396 bp, Homo sapiens
  misc_feature: HEFZJCU01D80E1.18.1.A01.1.454.heavy.3.raw
tacgagtatgcacgaccggtgctcgatttagacgtctcatcaaggaagggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactgggccagggcactccggtcaccgtctcctcagcctccaccaagggcccatcggtcttccccctggcaccctcctccaagagcacctctgggggcacagcggccctgggctgcctggtcaaggactacttcccatactcgta

SEQ ID NO: 453018 - DNA, 506 bp, Homo sapiens
  misc_feature: HEFZJCU01DRNJR.16.21.B10.1.454.heavy.3.raw
  modified_base (377)..(377): a, c, t, g, unknown or other
  modified_base (487)..(487): a, c, t, g, unknown or other
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttnaccatctccagagacaattccaagaacacactgtatctgcaaatgaacagcctgagagccgacgacacggccatatattactgtgcgaaagcaccggcaggttatcaccntactcttgactctgggccg

SEQ ID NO: 453019 - DNA, 506 bp, Homo sapiens
  misc_feature: HEFZJCU01EJ1EJ.52.81.H04.1.454.heavy.3.raw
cgcagtacgacacgaccggtgctcgatttagtagtgtagattcgcggggctctgagagaggagcccagccctgggattttcaggtgttttcatttggtgatcaggactgaacagagagaactcaccatggagtttgggctgagcgtggcgttttctaggtggctattttaaaaggtgtccagtgtgaggtgcagctgctgcagtcggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaagggccgcttcaccatctccagagacaattccaagaacacactgtatctgcaaatgaacagcctgagagccgaggacacggccacctatttctgtacgaaagaatacacacagctggacgaggagccaaac

SEQ ID NO: 453020 - DNA, 314 bp, Homo sapiens
  misc_feature: HEFZJCU01CQWQ2.7.10.A10.1.454.heavy.3.raw
cgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcccggtcaaggactacttcctagagacacg

SEQ ID NO: 453021 - DNA, 489 bp, Homo sapiens; identical to SEQ ID NO: 444591
  misc_feature: HEFZJCU01EQY6F.18.70.G04.1.454.heavy.3.raw

SEQ ID NO: 453022 - DNA, 529 bp, Homo sapiens
  misc_feature: HEFZJCU01B62IN.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatcttcaaatagacagcctgagaccagacgacacggctgtctattattgcgcgagagagacacacgaacctactggccaatactatgggggcttgttctggggccagggggaccctggtcatcgtctccccagcctccaccaagggcccatcggtcttcccctggcgccctgcc

SEQ ID NO: 453023 - DNA, 517 bp, Homo sapiens
  misc_feature: HEFZJCU01C7998.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttcccctggcaccctcctccaagagcacctctgggggcacagcggcctgggctgcctggtcaaggactacttcctagagacacg

SEQ ID NO: 453024 - DNA, 472 bp, Homo sapiens
  misc_feature: HEFZJCU01CFAHU.22.56.F01.1.454.heavy.3.raw
acatacgcgtcacgaccggtgctcgatttagcagacgtctgtcggggttctcattcaccactgcttcagtgggtgtgggctggatccgtcagcccccaggaaaggccctggagtggcttgcactcctttatggggatggcggtgaacactacagtccatctctgaagaccagactcaccatcgcccgggacacctccaagaaccaagtggtccttacactgaccagcatggaccctgtggacacaacaacatatttctgtgcacagagccgccagttagactggggggcctgtcgtggtggttggtgccgcaatgatgcatttcatatttggggccaagggacagtggtcaccgtctcggcagcctccaccaagggcccatcggtcttccccctggcgccctgctccaggagcacctccgagagcacagcggccctgggctgcctggtcaaggactacttccacgcgtatgt

SEQ ID NO: 453025 - DNA, 524 bp, Homo sapiens
  misc_feature: HEFZJCU01BHHZR.9.33.C11.1.454.heavy.3.raw
tgatacgtctcacgaccggtgctcgatttagagtgagctcgttgggtttgggctgagcgtggttttccgtcgttagctcttttaagaggtgtccagtgtcaagtgcaactggtggagtctgggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgccctgctccaggagcacctccg

SEQ ID NO: 453026 - DNA, 505 bp, Homo sapiens
  misc_feature: HEFZJCU01DMIUL.48.35.D02.1.454.heavy.3.raw
agtatacatacacgaccggtgctcgatttagcacacgatagttgggtttggggagctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtc

SEQ ID NO: 453027 - DNA, 487 bp, Homo sapiens; identical to SEQ ID NO: 452507
  misc_feature: HEFZJCU01DI53O.51.52.E08.1.454.heavy.3.raw

SEQ ID NO: 453028 - DNA, 384 bp, Homo sapiens
  misc_feature: HEFZJCU01B2IU9.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaaacgagttctccctggacttgacctctgtgaccgccgcagacacggctgttttattactgtgcgagacgactacctgactccaatccatactttgactattggggccggggagccctggtcaccgtctcctcagcctccaccaagggcccatcggtcttccccctggcgccctgctccaggagcacctccgagagcacagcggccctgggctgcctggtcaaggacttcccatactcgta

SEQ ID NO: 453029 - DNA, 520 bp, Homo sapiens
  misc_feature: HEFZJCU01ALADY.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactggggccagggaagcttggtcaccgtctcctcagcct

SEQ ID NO: 453030 - DNA, 384 bp, Homo sapiens; identical to SEQ ID NO: 444454
  misc_feature: HEFZJCU01EKK24.11.61.F06.1.454.heavy.3.raw

SEQ ID NO: 453031 - DNA, 505 bp, Homo sapiens
  misc_feature: HEFZJCU01AEIEM.53.33.C11.1.454.heavy.3.raw
cgcgtatacacacgaccggtgctcgatttagagtgagctcgttgggtttggggggaagaggaagactgacggtcctcccaggagttcaggtgctgggcaccgtgggcatgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaacgggccatcggtcttcccctcggcgccctgctcc

SEQ ID NO: 453032 - DNA, 539 bp, Homo sapiens
  misc_feature: HEFZJCU01ELPP7.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagcgtggagtttccttaggctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatccctgaaagcgtcaactactactactacggtatggacctctggggaccg

SEQ ID NO: 453033 - DNA, 515 bp, Homo sapiens
  misc_feature: HEFZJCU01CGVU3.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaagggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgttgttttcgatcgcctttccggtccggcgggtctttcgtcggggccgaacc

SEQ ID NO: 453034 - DNA, 395 bp, Homo sapiens; identical to SEQ ID NO: 444517
  misc_feature: HEFZJCU01BFW44.16.68.G02.1.454.heavy.3.raw

SEQ ID NO: 453035 - DNA, 501 bp, Homo sapiens
  misc_feature: HEFZJCU01BKA7K.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatggtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggac

SEQ ID NO: 453036 - DNA, 503 bp, Homo sapiens
  misc_feature: HEFZJCU01BRMNO.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaagacacggctgtgtattactgttcgagacgggctagtctgggatctagttatagtgactcgtcgttctggggaccg

SEQ ID NO: 453037 - DNA, 502 bp, Homo sapiens
  misc_feature: HEFZJCU01A7UWF.11.19.B08.1.454.heavy.3.raw
cgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccgccaggctccagggaaggggctggagtgggtttcatacatttctagtaattctggtaccatacactatgcagtctctgtgaagggccgattcaccatctccagagacaacgccaggaactcactttatctgcaaatgagcagcctggagagtcgaggacacgggtatttattactgtgcgagagatagtctgtctatgcttccgggagctaa

SEQ ID NO: 453038 - DNA, 508 bp, Homo sapiens; identical to SEQ ID NO: 445594
  misc_feature: HEFZJCU01BF3ED.17.25.C03.1.454.heavy.3.raw

SEQ ID NO: 453039 - DNA, 479 bp, Homo sapiens
  misc_feature: HEFZJCU01C8HCZ.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctggtcaaggactattccagacgtatca

SEQ ID NO: 453040 - DNA, 534 bp, Homo sapiens
  misc_feature: HEFZJCU01CZH8M.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccccttgggggcccggggaacccgtggtcaccgtcctccccaccctccaccg

SEQ ID NO: 453041 - DNA, 498 bp, Homo sapiens
  misc_feature: HEFZJCU01AD6NL.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactgggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 453042 - DNA, 520 bp, Homo sapiens
  misc_feature: HEFZJCU01ERBHF.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtcctcaagagtcgagtcatcatatccgtagacaggtccaggaacgaattctccctgaaagtgagttctgtgaccgtcgcagacacggctgtctattattgtgcgagacggcaaatatggttcagggagttcgactactggggccagggaaccctggtcaccgtctcctcagcctccaccaaggg

SEQ ID NO: 453043 - DNA, 392 bp, Homo sapiens; identical to SEQ ID NO: 444456
  misc_feature: HEFZJCU01BFO4A.7.60.F05.1.454.heavy.3.raw

SEQ ID NO: 453044 - DNA, 528 bp, Homo sapiens
  misc_feature: HEFZJCU01AGZIE.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctcccttgacttctgggccatggaacccggtccg

SEQ ID NO: 453045 - DNA, 396 bp, Homo sapiens; identical to SEQ ID NO: 444426
  misc_feature: HEFZJCU01CJFGJ.18.31.C09.1.454.heavy.3.raw

SEQ ID NO: 453046 - DNA, 504 bp, Homo sapiens
  misc_feature: HEFZJCU01ALWEY.3.71.G05.1.454.heavy.3.raw
agacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccgcaagctccagggaagggcctggagtgggtctcaggtattacttggaatagtgataacatcggctatgcggactctgtgaagggccgattcaccatctccagagacaacgccaagaacctccctgtatctgacaatgaacagtctgagacctgaggacacggccttgtattactgtgtaaagtcccggggaaatatgtacga

SEQ ID NO: 453047 - DNA, 513 bp, Homo sapiens
  misc_feature: HEFZJCU01EG7Z6.49.73.G07.1.454.heavy.3.raw
agtcgagagacacgaccggtgctcgatttagctctacgctcagggcacgaccggtgctcgatttagtgacatctcgcagttctttgggttttcctcgttgctcttttaagaggtgtccagtgtcaggtgcaactggtggagtctgggggaggcgtggtccagcctgggaggtccctgagactctcctgtgcagcctctggatttaccttcagcagctatgctatgcactggttccgccaggctccaggcaaggggctggagtgggtggcagttatttcatatgatggaagcgataaatactacgcagactccgtgaagggccgagtcaccatctccagacacaattccaagaacacggtgtttctgctggtgaacagcctgagaactgaggacacggctgtgtattactgtgcggcaggcaacgattactacccgaaggactactggggccagggaaccctggtcaccgtctcctcagcctccaccaacgggcccatcggtcttccccctggc

SEQ ID NO: 453048 - DNA, 427 bp, Homo sapiens; identical to SEQ ID NO: 444708
  misc_feature: HEFZJCU01EE3UD.9.34.D01.1.454.heavy.3.raw

SEQ ID NO: 453049 - DNA, 477 bp, Homo sapiens
  misc_feature: HEFZJCU01AQUKX.40.37.D04.1.454.heavy.3.raw
tctagcgactcacgaccggtgctcgatttagtagcatactgttgggtttggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccggggaatcctggtcaccgtctcctcagcctccaccaagggcccatcggtcttccccctggcgccctgctccaggagcacctccgagagcacagcggccctgggctgcctggtcaaggactacttccagtcgctaga

SEQ ID NO: 453050 - DNA, 513 bp, Homo sapiens
  misc_feature: HEFZJCU01DEHJC.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggtacttcgtggggtccagggaacctc

SEQ ID NO: 453051 - DNA, 482 bp, Homo sapiens; identical to SEQ ID NO: 444879
  misc_feature: HEFZJCU01B0XV5.11.23.C01.1.454.heavy.3.raw

SEQ ID NO: 453052 - DNA, 510 bp, Homo sapiens
  misc_feature: HEFZJCU01AHJE1.40.81.H04.1.454.heavy.3.raw
tctagcgactcacgaccggtgctcgatttagtagtgtagattcgcggggatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcgggactgacctctgacgacacggccatgtattactgtggaagagacgttggtggctaccggcggggctggaccacgtggggccagggtaacccg

SEQ ID NO: 453053 - DNA, 407 bp, Homo sapiens; identical to SEQ ID NO: 444621
  misc_feature: HEFZJCU01CKJAI.40.22.B11.1.454.heavy.3.raw

SEQ ID NO: 453054 - DNA, 498 bp, Homo sapiens; identical to SEQ ID NO: 449824
  misc_feature: HEFZJCU01B0NJX.47.38.D05.1.454.heavy.3.raw

SEQ ID NO: 453055 - DNA, 487 bp, Homo sapiens
  misc_feature: HEFZJCU01B8M5G.49.4.A04.1.454.heavy.3.raw
  modified_base (461)..(461): a, c, t, g, unknown or other
agtcgagagacacgaccggtgctcgatttagagtagtgatcagggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtgggtggcatttatctcatatgatggaagcaagatatactacattgactccgtgaagggccgattcatcatctccagagacaactccgagaacacactgtatcttcaaatgaacaggttgagagctgaagacacggctttanatttactgtgcgaacttaatcacgga

SEQ ID NO: 453056 - DNA, 499 bp, Homo sapiens
  misc_feature: HEFZJCU01AQPRN.11.71.G05.1.454.heavy.3.raw
  modified_base (469)..(469): a, c, t, g, unknown or other
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattacngtgcgaaagatttctatagaggtgacgtac

SEQ ID NO: 453057 - DNA, 502 bp, Homo sapiens
  misc_feature: HEFZJCU01BFB7H.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctgcgccctgctccagagcacctccgagagcacagcggccctgggctgcctggtcaggactacttcccactacta

SEQ ID NO: 453058 - DNA, 512 bp, Homo sapiens
  misc_feature: HEFZJCU01B3SII.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccaggggaactctgtcaccgtctccgcagcctccaccaaggccc

SEQ ID NO: 453059 - DNA, 498 bp, Homo sapiens
  misc_feature: HEFZJCU01C6N9F.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattggggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtgcttttgatgcctttgatatgtgggcaggacaatggtcacgt

SEQ ID NO: 453060 - DNA, 526 bp, Homo sapiens
  misc_feature: HEFZJCU01C5JTW.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacatgtatcttcaaatgaataacctgagagccgaggacacggccatgtattactgtgtggggcatttacttgaccctggggccgggaaccctggtcaccgtctccccaccctccaccg

SEQ ID NO: 453061 - DNA, 506 bp, Homo sapiens
  misc_feature: HEFZJCU01C4N2B.3.85.H08.1.454.heavy.3.raw
agacgcactccacgaccggtgctcgatttagtatcactcagtcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctggtggagtctgggggaggcttggtacagcctggggggtccctgagactctcctgtgcagcctctggattcacctttagtaattatgccatgagctgggtccgccaggctccagggaaggggctggagtgggtctcagctattagtgatcgtggtggtaacacatactacgcagactccgtgaagggccgcttcaccatctccagagacaattccaagaacacgctgcatctgcaaatgaacagcctgagagccgaggacacggccctttattactgtgcgaaaccaatcacgtataactggaactacgta

SEQ ID NO: 453062 - DNA, 514 bp, Homo sapiens
  misc_feature: HEFZJCU01A20X9.13.87.H10.1.454.heavy.3.raw
tcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggcgattcaccatctccagagacaacgccaagaactccctgtatctgcaaatgaacagcctgagagctgaggacacggccttgtattattgtgacaaagatacccaaccccttacgtatttttggagtggttacg

SEQ ID NO: 453063 - DNA, 486 bp, Homo sapiens
  misc_feature: HEFZJCU01BG7U4.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggagcgtggcccagcctgggaggtccctcagactctcctgtgcagcgtctggattcagtttcgctacacatggcatgcactgggtccgccagtctccaggcaaggggctgcagtgggtgcgtttattcgaagcgatgggactcatgaacaatatgcagactccgtgaagggccgattcatcatctccagagacaactccaacaacacactggatctccaaatgaacagcctgagagtcgaggacacggccgtatattattgtgcccttgatttacta

SEQ ID NO: 453064 - DNA, 482 bp, Homo sapiens; identical to SEQ ID NO: 444503
  misc_feature: HEFZJCU01CV69L.7.10.A10.1.454.heavy.3.raw

SEQ ID NO: 453065 - DNA, 373 bp, Homo sapiens; identical to SEQ ID NO: 445918
  misc_feature: HEFZJCU01D86BP.49.30.C08.1.454.heavy.3.raw

SEQ ID NO: 453066 - DNA, 488 bp, Homo sapiens
  misc_feature: HEFZJCU01EDPH1.18.70.G04.1.454.heavy.3.raw
  modified_base (425)..(425): a, c, t, g, unknown or other
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccnggagcacctccgagagcacagcggccctgggctgcctggtcaaggactacttccatactcgta

SEQ ID NO: 453067 - DNA, 519 bp, Homo sapiens; identical to SEQ ID NO: 444867
  misc_feature: HEFZJCU01BNOQM.9.34.D01.1.454.heavy.3.raw

SEQ ID NO: 453068 - DNA, 529 bp, Homo sapiens
  misc_feature: HEFZJCU01BV2H2.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaacccgtggtcaccgtctccccaccctccaccg

SEQ ID NO: 453069 - DNA, 553 bp, Homo sapiens
  misc_feature: HEFZJCU01DEK4I.18.14.B03.1.454.heavy.3.raw
tacgagtatgcacgaccggtgctcgatttagtgtgagtagtttgggctgagctgggttttccttgttgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacggtatggacctctggggccaagggaccacggtcaccgtcctcccaccctccaccaagggcccatcggtctcccctggcaccctcctccaagagcacctctgggggcacagcggccctgggctgcctcggtcg

SEQ ID NO: 453070 - DNA, 379 bp, Homo sapiens; identical to SEQ ID NO: 444450
  misc_feature: HEFZJCU01AD2TI.47.77.G11.1.454.heavy.3.raw

SEQ ID NO: 453071 - DNA, 437 bp, Homo sapiens; identical to SEQ ID NO: 447018
  misc_feature: HEFZJCU01EQGHC.40.27.C05.1.454.heavy.3.raw

SEQ ID NO: 453072 - DNA, 517 bp, Homo sapiens
  misc_feature: HEFZJCU01BRCDC.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccacaagggccccatcc

SEQ ID NO: 453073 - DNA, 500 bp, Homo sapiens
  misc_feature: HEFZJCU01DUM1X.9.81.H04.1.454.heavy.3.raw
tgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtctgggggagcttggtgcagcctggcacctccctgagactctcctgtgccgcctctggattcatgtttgatgattatgccatgcactgggtccggcaagttccagggaagggcctggagtgggtctcaggttattacttggagtagcactaccacaggctatgcggactctgtgaggggccgattcaccatctccagagacaacgccaagaactccctatatctgcaaatgaatggtctgagagttgaggacacggccttgtattactgtgacaaagatggaaacccaggtggacg

SEQ ID NO: 453074 - DNA, 503 bp, Homo sapiens
  misc_feature: HEFZJCU01DPWJJ.52.81.H04.1.454.heavy.3.raw
  modified_base (467)..(467): a, c, t, g, unknown or other
cgcagtacgacacgaccggtgctcgatttagtagtgtagattcgcgggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgcagtcggggggaggcttggtacagcctggggggtccctgagactctcctgtgcagcctctggattcacctttcgcgtctatgacatgagctgggtccgccaggctccaggaatggggctggagtgggtctcaggtattaatagtggtggaagtacatattacgcagactccgtgaagggccgcttcaccatctccagagacaattccaagaacacactgtatctgcaaatgaacagcctgagagccgaggacacggccacctatttcngtacgaagaatacacacagctgacgaggagccaaac

SEQ ID NO: 453075 - DNA, 532 bp, Homo sapiens
  misc_feature: HEFZJCU01AKIJH.12.12.B01.1.454.heavy.3.raw
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtggattgggagtatctattttagcgggagcacctaccagaacgcgtccctcaagagtcgaatcaccatgtcggtggacacatcgaagaaccagatctcccttaagttgaggtctgtgaccgccgctgacacggccgtctattactgtgcgagagtccgtgctggaagaacacttttttgacttattggggccagggaatcctggtcaccgtcgcctcagcctccaccaaggcccatcggtcttcccccg

SEQ ID NO: 453076 - DNA, 499 bp, Homo sapiens
  misc_feature: HEFZJCU01BV10P.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacaggtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcttttgatgcctttgatatgtggggcaagggacaatggtcaccgtct

SEQ ID NO: 453077 - DNA, 497 bp, Homo sapiens
  misc_feature: HEFZJCU01CMYB7.52.86.H09.1.454.heavy.3.raw
cgcagtacgacacgaccggtgctcgatttagtgctatagacttgggtttgggctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctgggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctggaggacacggctatgttttactgtgcgagagggaactcgattacagcag

SEQ ID NO: 453078 - DNA, 518 bp, Homo sapiens
  misc_feature: HEFZJCU01D7T71.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaagggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgacccctggggccagggaaccctggtcaccgtctcctcag

SEQ ID NO: 453079 - DNA, 508 bp, Homo sapiens
  misc_feature: HEFZJCU01AZXHF.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatcccgggtgacgcctacggcaggcggcctttgacttcgtc

SEQ ID NO: 453080 - DNA, 398 bp, Homo sapiens; identical to SEQ ID NO: 444524
  misc_feature: HEFZJCU01BOAIT.7.60.F05.1.454.heavy.3.raw

SEQ ID NO: 453081 - DNA, 505 bp, Homo sapiens; identical to SEQ ID NO: 444759
  misc_feature: HEFZJCU01DC7XO.10.38.D05.1.454.heavy.3.raw

SEQ ID NO: 453082 - DNA, 519 bp, Homo sapiens
  misc_feature: HEFZJCU01CYYSG.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttaggggtagttttacgtatttttggtagtggatatttaa

SEQ ID NO: 453083 - DNA, 511 bp, Homo sapiens
  misc_feature: HEFZJCU01ETARA.8.37.D04.1.454.heavy.3.raw
ctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagcttttgaattttggggccaagggacaatggtcatcgtctcctcagcctccaccaagggcccatcggtcttccccctggcaccctcctccaagagcacctctgggggcacagcggccctgggctgccg

SEQ ID NO: 453084 - DNA, 408 bp, Homo sapiens
  misc_feature: HEFZJCU01CX0VH.13.46.E02.1.454.heavy.3.raw
tcacgtactacacgaccggtgctcgatttagactcatctacagggaaaggggctggagtgggtaggtttcattaggagcaattctcatgatgggacaacagaatacgccgcgtctgtaaaaggcagattcaccatctcaagagatgagtccagaagcatcgcctttctgcagatgagtagcctgaagaccgaggacacagccatctattactgtgctagagagtattgcagtcctacgacctgctatgggggccttggtggccactggggccagggcaccctggtcaccgtctccgcagcctccaccaagggcccatcggtcttccccctggcaccctcctccaagagcacctctgggggcacagcggccctgggctgcctggtcaaggactacttcctagtacgtga

SEQ ID NO: 453085 - DNA, 314 bp, Homo sapiens; identical to SEQ ID NO: 444774
  misc_feature: HEFZJCU01DZ7GW.7.10.A10.1.454.heavy.3.raw

SEQ ID NO: 453086 - DNA, 494 bp, Homo sapiens
  misc_feature: HEFZJCU01DLPK1.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggccatcggtcttcccctggcaccctcctccaagagcacctctgggggcacagcggccctgggctgcctggtcaaggactactccgagtagtaca

SEQ ID NO: 453087 - DNA, 395 bp, Homo sapiens
  misc_feature: HEFZJCU01CJRZT.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctgggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 453088 - DNA, 513 bp, Homo sapiens
  misc_feature: HEFZJCU01DLPSD.2.81.H04.1.454.heavy.3.raw
  modified_base (405)..(405): a, c, t, g, unknown or other
  modified_base (461)..(461): a, c, t, g, unknown or other
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggagctgggtccagcctgggggtccctgagactctcctgttcagcctctggattcacctttagtaggttttggatgagttgggtccgccaggctccagggaaggggctggagtgggtggccaacatagagtacgatggaagtgagaaaaactntgtggactcgtgaagggccgattcaccatctccagagacaacgacaagaatttagngtatctgcaaatgagcagcctgagagccgaggacacggctgtgtattatgtg

SEQ ID NO: 453089 - DNA, 395 bp, Homo sapiens; identical to SEQ ID NO: 445907
  misc_feature: HEFZJCU01DI44T.47.59.F04.1.454.heavy.3.raw

SEQ ID NO: 453090 - DNA, 527 bp, Homo sapiens
  misc_feature: HEFZJCU01ANOLI.46.33.C11.1.454.heavy.3.raw
actagcagtacacgaccggtgctcgatttagagtgagctcgtgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccgaggcgggagttccaagtactcctttgacgtctggggccagggtacccg

SEQ ID NO: 453091 - DNA, 476 bp, Homo sapiens; identical to SEQ ID NO: 448842
  misc_feature: HEFZJCU01DC2K6.16.10.A10.1.454.heavy.3.raw

SEQ ID NO: 453092 - DNA, 497 bp, Homo sapiens
  misc_feature: HEFZJCU01EXZOM.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaagatttctatagaggtgactacgggggcgttcg

SEQ ID NO: 453093 - DNA, 501 bp, Homo sapiens
  misc_feature: HEFZJCU01CNMKH.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgacctttctggtatttcgatctctggggccgtggcaccctggtcactgtctcctcggcttccaccaagggcccatcggtcttcccctggcgcctgctccagagcacctctggggcac

SEQ ID NO: 453094 - DNA, 487 bp, Homo sapiens
  misc_feature: HEFZJCU01CBW20.47.55.E11.1.454.heavy.3.raw
agctcacgtacacgaccggtgctcgatttagcactcgcacgttgggtttgggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccatgaggggccgattcagcatctccagagacaacggcaagagtatactgtatctggaaatgaacaatctgagagtcgacgatacggctgtctatcattgtgttttcgatgccttcggtccgcgggacttctggggccagggaaccctggtcagcgtctcctcagcctccaccaagggcccatcggtcttccccctggcgccctgctccaggagcacctccgagagcacagcggccctgggctgcctggtcaaggactacttcctacgtgagct

SEQ ID NO: 453095 - DNA, 493 bp, Homo sapiens
  misc_feature: HEFZJCU01DEHW4.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactggtgggagagatggaggtcgatattgt

SEQ ID NO: 453096 - DNA, 522 bp, Homo sapiens
  misc_feature: HEFZJCU01A67XN.52.38.D05.1.454.heavy.3.raw
cgcagtacgacacgaccggtgctcgatttagtatctgatagttgggtttggggtctgagagaggaggccagccctgggattttcaggtgttttcatttggtgatcaggactgaacagagagaactcaccatggagtttgggctgagctggctctttcttgtggctattttaaaaggtgtccagtgtgacgtacagctggtggagtcggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttattactgtgcgaaagatcgaggtcgcatgacagtttttggagtggccaaagacggc

SEQ ID NO: 453097 - DNA, 483 bp, Homo sapiens
  misc_feature: HEFZJCU01CQZLY.19.71.G05.1.454.heavy.3.raw
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccccatagacatgccacctcgtctctggtgct

SEQ ID NO: 453098 - DNA, 396 bp, Homo sapiens; identical to SEQ ID NO: 444731
  misc_feature: HEFZJCU01BZ4R0.18.61.F06.1.454.heavy.3.raw

SEQ ID NO: 453099 - DNA, 523 bp, Homo sapiens
  misc_feature: HEFZJCU01C88RD.22.11.A11.1.454.heavy.3.raw
acatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaattccaagccgcgggggtcacccaaattgactactggggccagggaaccctggtcaccgtctcctcagcctccaccaagggcccatcggtcttcccctggcgccctgctccac

SEQ ID NO: 453100 - DNA, 493 bp, Homo sapiens
  misc_feature: HEFZJCU01CBI0Y.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgta

SEQ ID NO: 453101 - DNA, 400 bp, Homo sapiens; identical to SEQ ID NO: 444452
  misc_feature: HEFZJCU01B5GN8.47.24.C02.1.454.heavy.3.raw

SEQ ID NO: 453102 - DNA, 525 bp, Homo sapiens
  misc_feature: HEFZJCU01ERQMO.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaagggcccatcggtcttcccctggcaccctcctccaagagcacctctgggggcacagcggcctgggctgcctggtcaaggactacttcccatactcgta

SEQ ID NO: 453103 - DNA, 506 bp, Homo sapiens; identical to SEQ ID NO: 445682
  misc_feature: HEFZJCU01C7AWK.48.44.D11.1.454.heavy.3.raw

SEQ ID NO: 453104 - DNA, 514 bp, Homo sapiens
  misc_feature: HEFZJCU01D10OG.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccgggtgagccctacgggccaggccggccttttggacctttcgtc

SEQ ID NO: 453105 - DNA, 526 bp, Homo sapiens
  misc_feature: HEFZJCU01B87B4.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctcccaccctccaccaagggcccatcggtcttccccctggcaccctcctccaagagcacctctgggggcacagcggccctgggctgcctggtcaaggactacttcccatactcgta

SEQ ID NO: 453106 - DNA, 520 bp, Homo sapiens
  misc_feature: HEFZJCU01ADQ6C.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctgggccgtggcaccctggtcactgtctttctcagcctccaccaagggcccatcggtcttccccctggcaccctcctccaagagcacctctgggggcacagcggccctgggctgcctggtcaaggactacttcctatacgac

SEQ ID NO: 453107 - DNA, 427 bp, Homo sapiens; identical to SEQ ID NO: 444708
  misc_feature: HEFZJCU01BJJVI.9.34.D01.1.454.heavy.3.raw

SEQ ID NO: 453108 - DNA, 375 bp, Homo sapiens; identical to SEQ ID NO: 445125
  misc_feature: HEFZJCU01A10GW.9.53.E09.1.454.heavy.3.raw

SEQ ID NO: 453109 - DNA, 521 bp, Homo sapiens
  misc_feature: HEFZJCU01BK2YP.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtcctcaagagtcgagtcatcatatccgtagacaggtccaggaacgaattctccctgaaagtgagttctgtgaccgtcgcagacacggctgtctattattgtgcgagacggcaaatatggttcaggggagttcgactactggggccagggaaccctggtcaccgtctcctcagcctccaccaaggg

SEQ ID NO: 453110 - DNA, 511 bp, Homo sapiens
  misc_feature: HEFZJCU01BLCW9.3.71.G05.1.454.heavy.3.raw
agacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaaggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgtgtaaagtcccggggaaatatgtacgtattttggaactt

SEQ ID NO: 453111 - DNA, 396 bp, Homo sapiens; identical to SEQ ID NO: 444469
  misc_feature: HEFZJCU01D890Q.47.46.E02.1.454.heavy.3.raw

SEQ ID NO: 453112 - DNA, 502 bp, Homo sapiens
  misc_feature: HEFZJCU01EP2IU.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactgggccagggcaccctggtcaccgtctcctcagcttccaccaagggcccatcggtcttcccctggcgccctgctccaggagcacctctgggacacagcgcctggctgcctggtcaaggactactccat

SEQ ID NO: 453113 - DNA, 500 bp, Homo sapiens
  misc_feature: HEFZJCU01DI3OA.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccagagcacctccgacgagcacagcggcctgggctgcctggtcaaggactactcccacta

SEQ ID NO: 453114 - DNA, 533 bp, Homo sapiens
  misc_feature: HEFZJCU01CV4YD.40.44.D11.1.454.heavy.3.raw
tctagcgactcacgaccggtgctcgatttagcgcagtacgaagggggctttctgagagtcatggacctcctgcacaagaacatgaaacacctgtggttcttcctcctcctggtggcagctcccagatgggtcctgtcccaggtgcagctacagcagtggggcacaagactgttgaagccttcggagaccctgtccttcacctgcgctgtctatggtgggtccttcagtggttactactggacctggatccgccagcccccagggaaggggctggagtggattggggaaatcaatcatagtggaagcaccaactacaacccgtcactcaagagtcgactcaccatatcagtagacacgtccaagaaccagttctccctgaagctgagctctgtgaccgccgcgggacacggctgtgtattactgtgcgagaggcttggtaggcagtggctcccgggggccttttgactactgggtccagggaacccgtgggtccaccggtcctccgtccacgcctccaccaacgggcccgatcc

SEQ ID NO: 453115 - DNA, 491 bp, Homo sapiens; identical to SEQ ID NO: 444592
  misc_feature: HEFZJCU01CLZV0.11.26.C04.1.454.heavy.3.raw

SEQ ID NO: 453116 - DNA, 503 bp, Homo sapiens
  misc_feature: HEFZJCU01BDZBL.52.70.G04.1.454.heavy.3.raw
  modified_base (501)..(501): a, c, t, g, unknown or other
cgcagtacgacacgaccggtgctcgatttagtgtagtgtgaagggaaaggggacccaacaaccacatccctcctcagaagcccccagagcacaacgcctcaccatggactggacctggaggatcctctttttggtggcagcagccacaggtgcccactcccaggtccaaattgtgcagtctggggctgaggtgaagaagcctggggcctcagtgaaggtttcctgcaaggcttctggatacagtttcactaggtattcgatgcattggctgcgccaggcccccggacaaaggcctgagtggatgggaagtctcagtgatggcaaaggtgacaaaaagtattcacagaagttccagggcagagtcaccattaccagcgacgcatccgcgaacacagcctatatggaactcagcagcctgagatctgaagacacggctgtctattctgtgcgagggtcggcacggctgacaactcttacttctattcctacgctatggacgtntc

SEQ ID NO: 453117 - DNA, 518 bp, Homo sapiens
  misc_feature: HEFZJCU01AT19W.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggggccgggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 453118 - DNA, 481 bp, Homo sapiens
  misc_feature: HEFZJCU01CLCBK.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggccatcggtcttcccctggcaccctcctccaagagcacctctgggggcacagcggccctgggctgcctggtcaaggactacttcctagagacacg

SEQ ID NO: 453119 - DNA, 532 bp, Homo sapiens
  misc_feature: HEFZJCU01AU92Z.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatgggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaaggg

SEQ ID NO: 453120 - DNA, 423 bp, Homo sapiens; identical to SEQ ID NO: 444772
  misc_feature: HEFZJCU01AL1VN.16.78.H01.1.454.heavy.3.raw

SEQ ID NO: 453121 - DNA, 396 bp, Homo sapiens; identical to SEQ ID NO: 444469
  misc_feature: HEFZJCU01DGCL0.47.46.E02.1.454.heavy.3.raw

SEQ ID NO: 453122 - DNA, 512 bp, Homo sapiens
  misc_feature: HEFZJCU01AIUVS.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggcccctggg

SEQ ID NO: 453123 - DNA, 499 bp, Homo sapiens
  misc_feature: HEFZJCU01DMLMT.47.56.F01.1.454.heavy.3.raw
agctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgctattttaaaaggtgtccagtgtgaggtgcaactggtggagtccgggggaggcttaattcagcctggggggtccctgagactctcctgtgcagcctctggattcaccttcagtagttactggatgcactgggtccgccaagctccagggaagggactggtgtgggtctcacgtattaatcctgatggaagtcgcacaaactacgcggactccgtgagggaccgattcaccatctccagagacaacgccaagaacacgctgtatctgcaaatgcacagtctgagagccgacgatgcggctgtatatttctgtgcaagagatcaactggtgggaccgactttatttc

SEQ ID NO: 453124 - DNA, 531 bp, Homo sapiens
  misc_feature: HEFZJCU01C5Y0O.49.78.H01.1.454.heavy.3.raw
agtcgagagacacgaccggtgctcgatttagtgtgagtagtttgggtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaaccctggtcaccgtctcctcagcctccaccaagggcccatcggtcttcccctggcgccctgctccaggagcacctccgagagcacacgcggcccg

SEQ ID NO: 453125 - DNA, 387 bp, Homo sapiens; identical to SEQ ID NO: 445229
  misc_feature: HEFZJCU01D52EU.11.20.B09.1.454.heavy.3.raw

SEQ ID NO: 453126 - DNA, 529 bp, Homo sapiens
  misc_feature: HEFZJCU01BISZE.14.35.D02.1.454.heavy.3.raw
cgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactggggccagggaaccctggtcaccgtctcctcagcctccaccaagggcccatcggtcttccccctggcaccctcctccaagagcacctctggggacacagcggccctgggctgcctggtcaaggactacttccg

SEQ ID NO: 453127 - DNA, 392 bp, Homo sapiens; identical to SEQ ID NO: 444682
  misc_feature: HEFZJCU01BBWXT.16.70.G04.1.454.heavy.3.raw

SEQ ID NO: 453128 - DNA, 507 bp, Homo sapiens
  misc_feature: HEFZJCU01CPN04.22.86.H09.1.454.heavy.3.raw
acatacgcgtcacgaccggtgctcgatttagtgctatagacttgggtttggggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccctggcgcctgctccaggacg

SEQ ID NO: 453129 - DNA, 508 bp, Homo sapiens; identical to SEQ ID NO: 445911
  misc_feature: HEFZJCU01B2ETK.12.78.H01.1.454.heavy.3.raw

SEQ ID NO: 453130 - DNA, 505 bp, Homo sapiens
  misc_feature: HEFZJCU01CKLOS.48.20.B09.1.454.heavy.3.raw
agtatacatacacgaccggtgctcgatttagtgtagtgtgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 453131 - DNA, 496 bp, Homo sapiens; identical to SEQ ID NO: 444697
  misc_feature: HEFZJCU01EMLHY.16.37.D04.1.454.heavy.3.raw

SEQ ID NO: 453132 - DNA, 522 bp, Homo sapiens
  misc_feature: HEFZJCU01A40MX.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaagggcccatcggtcttcccctggccgcctgctccaggagcacctccg

SEQ ID NO: 453133 - DNA, 393 bp, Homo sapiens
  misc_feature: HEFZJCU01DY5W3.10.42.D09.1.454.heavy.3.raw
catagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaagggctggttacatgtttgactcctggggccagggaatcctggtcaccgtctcctcagcctccaccaagggcccatcggtcttccccctggcgccctgctccaggagcacctccgagagcacagcggccctgggctgcctggtcaaggctacttccactactatg

SEQ ID NO: 453134 - DNA, 526 bp, Homo sapiens
  misc_feature: HEFZJCU01ALY4V.49.37.D04.1.454.heavy.3.raw
agtcgagagacacgaccggtgctcgatttagtagcatactgttgggtttgggggatttgggggcaatttatgaacccgaaaggacatggccatggggtgggtagggacagtagggacagatgtcagcctgaggtgaagcctcaggacacaggtgggcatggacagtgtccacctaagcgagggacagacccgagtgtccctgcagtagacctgagagcgctgggcccacagcctcccctcggggccctgctgcctcctcaggtcagccctggacatcccggctttccccaggcctggcggtaggtttgaagtgaggtctgtgtcactgtggtcttactatgatagtagtggttatattagcagccactcagcacattcggctactggggccagggaaccctggtcaccgtctcctcagcctccaccaagggcccatcggtcttccccctggcaccctcctccaagagcacctctgggggcacagcggccctgggctgcctgtcaaggactacttcctctctcgact

SEQ ID NO: 453135 - DNA, 519 bp, Homo sapiens
  misc_feature: HEFZJCU01DCW52.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 453136 - DNA, 465 bp, Homo sapiens
  misc_feature: HEFZJCU01CMCKH.9.34.D01.1.454.heavy.3.raw
tgatacgtctcacgaccggtgctcgatttagatcgtctgtgttgggtttgggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccattatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 453137 - DNA, 536 bp, Homo sapiens
  misc_feature: HEFZJCU01D7BBM.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggctttcatgtctggggccaagggacgctggtcaccgtctcttcagcctccaccaagggcccatcggtcttcccctggcaccctcctccaagagcacctctgggggcacagcc

SEQ ID NO: 453138 - DNA, 532 bp, Homo sapiens
  misc_feature: HEFZJCU01CM4XM.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccgggggaaccctggtcaccgtctccccaccctccaacccg

SEQ ID NO: 453139 - DNA, 379 bp, Homo sapiens; identical to SEQ ID NO: 444450
  misc_feature: HEFZJCU01ASQ1U.47.77.G11.1.454.heavy.3.raw

SEQ ID NO: 453140 - DNA, 501 bp, Homo sapiens
  misc_feature: HEFZJCU01BRFYM.51.7.A07.1.454.heavy.3.raw
  modified_base (331)..(331): a, c, t, g, unknown or other
  modified_base (495)..(495): a, c, t, g, unknown or other
cgatcgtatacacgaccggtgctcgatttagcacgtgtcgcaggggtccgggagaggagcccagcactagaagtcggcggtgtttccactcggtgatgagcactgaacacagaggactcaccatggagtttgggctgagctgggttttcctcgttgctcttttaagaggtgtccagtgtcaggtgcacctggtggaatctgggggaggcgtggtccagcctgggaggtccctgagactctcttgtgtaggctctggattcagcttcagcaactatggcatgcactgggtccgccaggccccaggcgaggggctgcagtgggtggcagttanatcgtctgatgcaagtaatgaacattatggagaatccgtgaagggccgattcaccatctccagagacaattccaggaacacggtgtttctgcaaatgaacaggctgatacctgaggacacggctgtctattattgtgtgaagggtcccgtgacaaacttcgganacttcc

SEQ ID NO: 453141 - DNA, 494 bp, Homo sapiens
  misc_feature: HEFZJCU01D3H6O.52.14.B03.1.454.heavy.3.raw
cgcagtacgacacgaccggtgctcgatttagtgtgagtagttccgcgggcacgaccggtgctcgatttagtatcactcagtcgcggggtatcactcagtcgcggggatactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctgatgcctccatcagtcgtgacgattactactggagctggatccgccagcccccagggaagggcctggaatggattggctacatctttacagtgagagcacctcctacaacccgtccctcaagagtcgagttaccatatcagctgacaagtccaagaaccacttctccctgaagctgacctctgtgactgccacagacacggccgtctattactgtgcca

SEQ ID NO: 453142 - DNA, 372 bp, Homo sapiens; identical to SEQ ID NO: 446639
  misc_feature: HEFZJCU01EF7LB.49.46.E02.1.454.heavy.3.raw

SEQ ID NO: 453143 - DNA, 463 bp, Homo sapiens; identical to SEQ ID NO: 446208
  misc_feature: HEFZJCU01BT19C.19.10.A10.1.454.heavy.3.raw

SEQ ID NO: 453144 - DNA, 510 bp, Homo sapiens
  misc_feature: HEFZJCU01EXQKW.48.22.B11.1.454.heavy.3.raw
agtatacatacacgaccggtgctcgatttagacgacagctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcttttgtatgtcctttgactatgtggggccgaagggacaatggtctaccggtccttccg

SEQ ID NO: 453145 - DNA, 490 bp, Homo sapiens; identical to SEQ ID NO: 448082
  misc_feature: HEFZJCU01BU9TC.47.85.H08.1.454.heavy.3.raw

SEQ ID NO: 453146 - DNA, 505 bp, Homo sapiens; identical to SEQ ID NO: 447076
  misc_feature: HEFZJCU01COIES.10.38.D05.1.454.heavy.3.raw

SEQ ID NO: 453147 - DNA, 489 bp, Homo sapiens; identical to SEQ ID NO: 448298
  misc_feature: HEFZJCU01BEC60.12.53.E09.1.454.heavy.3.raw

SEQ ID NO: 453148 - DNA, 519 bp, Homo sapiens
  misc_feature: HEFZJCU01A4RGH.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacgagcggccctgggctgcctggtcaaggactacttccagacgtatca

SEQ ID NO: 453149 - DNA, 469 bp, Homo sapiens
  misc_feature: HEFZJCU01CAUYH.15.1.A01.1.454.heavy.3.raw
tctacgtagccacgaccggtgctcgatttagacgtctcatcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacgggtataatagttactggtttggccactggggccagggaaccctggtcatcgtctcgtcagcctccaccaagggcccatcggtcttcccctggcaccctcctccaagagcacctctgggggcacagcggcctgggctgcctggtcaaggactacttccgctacgtaga

SEQ ID NO: 453150 - DNA, 513 bp, Homo sapiens
  misc_feature: HEFZJCU01EQIS1.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagcgtgcgttttctaggtggctaattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagtagtcacccatactactttgactactggggccaac

SEQ ID NO: 453151 - DNA, 502 bp, Homo sapiens; identical to SEQ ID NO: 445538
  misc_feature: HEFZJCU01CHW08.17.10.A10.1.454.heavy.3.raw

SEQ ID NO: 453152 - DNA, 526 bp, Homo sapiens
  misc_feature: HEFZJCU01D3E3Y.52.5.A05.1.454.heavy.3.raw
cgcagtacgacacgaccggtgctcgatttagatagatagacagggggctctgggaaaggagccccagccctgagattcccaggtgtttccattcggtgatcagcactgaacacagaactcaccatggagtttggactgagctgggttttccttgttgctattttaaaaggtgtccaggctgaagtgcagctggtggaatctgggggaatcgtggtgcggcctggggggtccctgagactctcctgttcagccgctggattcacgtttgatgattatgccatgtactgggtccgtcaagctccggggaaggtctggagtgggtctctcttgtgaattgggatggcagtgcttcttattacgccgactctgtgaagggtcggttcaccatctccagagacaacagaaaaactccctatatcttcaaatgagaagtctgagaattgaggacaccgccttatattactgcgctaaaggccttgacgcgttggctataaatggattggaccactggggccagggaacccac

SEQ ID NO: 453153 - DNA, 524 bp, Homo sapiens; identical to SEQ ID NO: 446418
  misc_feature: HEFZJCU01AC64V.53.76.G10.1.454.heavy.3.raw

SEQ ID NO: 453154 - DNA, 492 bp, Homo sapiens; identical to SEQ ID NO: 445919
  misc_feature: HEFZJCU01BN6TK.14.25.C03.1.454.heavy.3.raw

SEQ ID NO: 453155 - DNA, 396 bp, Homo sapiens; identical to SEQ ID NO: 444469
  misc_feature: HEFZJCU01BKDOE.47.46.E02.1.454.heavy.3.raw

SEQ ID NO: 453156 - DNA, 518 bp, Homo sapiens
  misc_feature: HEFZJCU01EOBIB.49.59.F04.1.454.heavy.3.raw
agtcgagagacacgaccggtgctcgatttagtacacacacttagggattggggacacataacaaccagattcctcctctaaagaagcccctgggagcacagctcatcaccatggactggacctggaggttcctctttgtggtggcagcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactggggccaggggaaccctggtccg

SEQ ID NO: 453157 - DNA, 508 bp, Homo sapiens
  misc_feature: HEFZJCU01DWUC6.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattacctgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctggctgcctggtcaggactacttcctacgtcgtat

SEQ ID NO: 453158 - DNA, 375 bp, Homo sapiens; identical to SEQ ID NO: 444459
  misc_feature: HEFZJCU01ALQX6.48.59.F04.1.454.heavy.3.raw

SEQ ID NO: 453159 - DNA, 510 bp, Homo sapiens; identical to SEQ ID NO: 448108
  misc_feature: HEFZJCU01EFC3L.11.13.B02.1.454.heavy.3.raw

SEQ ID NO: 453160 - DNA, 536 bp, Homo sapiens
  misc_feature: HEFZJCU01CIPCP.52.57.F02.1.454.heavy.3.raw
cgcagtacgacacgaccggtgctcgatttagctcgatatagttgggtttgggctgagctggctctttcttgtggctattttaaaaggtgtccagtgtgacgtacagctggtggagtcggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttattactgtgcgaaagatcgaggtcgcatgacagttttggagtggccaaagacggcaggttccgctacgggttggacgtctggggccaagggaccacggtcaccgtcgcctcagcctccaccaagggcccatcggtcttcccctggcacctcctccagag

SEQ ID NO: 453161 - DNA, 483 bp, Homo sapiens; identical to SEQ ID NO: 444924
  misc_feature: HEFZJCU01DOGLR.10.35.D02.1.454.heavy.3.raw

SEQ ID NO: 453162 - DNA, 475 bp, Homo sapiens
  misc_feature: HEFZJCU01BEDV0.3.39.D06.1.454.heavy.3.raw
agacgcactccacgaccggtgctcgatttagtgacatctcgcagttctttgggttttggggggtccctgagactctcatgtacaggctctgagttcagcgtcactaaatactacatgagctgggtccgccaggctccagggaggggactggactgggtctccagtgttaacagcgatggaagtacatattatgcagactccgtgaagggccgattcaccatctccagagacaattccaagaacactctgtatcttcaaatgaacagcctgagagccgaggacacggccttctattactgtgcgagcgatcacgggcggagtctgatactttcttggggccagggaaccctggtcaccgtctcctcagcctccaccaagggcccatcggtcttcccctcggcgccctgctccaggagcacctccgagagcacagcggccctgggctgcctggtcaggactacttccgagtgcgtct

SEQ ID NO: 453163 - DNA, 499 bp, Homo sapiens
  misc_feature: HEFZJCU01CBZUP.22.5.A05.1.454.heavy.3.raw
acatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagcccccaggaaaggccctagactggcttgcactcatttattggaatgatgataagcgctacagcccatctctgaagagcagactcaacatcaccaaggacacctccaaaaagcaagtggtccttacaatgaccaacatggaccctttggacacagccacatattactgtgcacaccacagggtctctactgctggctttcagtacaactggttcgaaccctggggccagggaaccctggtcagcgtctcctcagcct

SEQ ID NO: 453164 - DNA, 510 bp, Homo sapiens
  misc_feature: HEFZJCU01CFJMD.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcacgtctccgcagcctcaccaaggccc

SEQ ID NO: 453165 - DNA, 492 bp, Homo sapiens; identical to SEQ ID NO: 444827
  misc_feature: HEFZJCU01DTNNJ.4.28.C06.1.454.heavy.3.raw

SEQ ID NO: 453166 - DNA, 397 bp, Homo sapiens
  misc_feature: HEFZJCU01DYRLQ.48.62.F07.1.454.heavy.3.raw
agtatacatacacgaccggtgctcgatttagtagtcgcataaagggaaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctgggggcacagcggccctgggctgcctggtcaaggactacttcctatgtatact

SEQ ID NO: 453167 - DNA, 489 bp, Homo sapiens; identical to SEQ ID NO: 444791
  misc_feature: HEFZJCU01B4VBM.47.85.H08.1.454.heavy.3.raw

SEQ ID NO: 453168 - DNA, 515 bp, Homo sapiens
  misc_feature: HEFZJCU01BW1TS.13.10.A10.1.454.heavy.3.raw
tcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccagggaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgaccctgggcccgggaaccctggtcaccgtctcctcagcctccaccaagggcccatcggtcttccccctggccaccctcctccagagcacctctgggggcacgagcggccctgggctgcctggtcaaggactacttcc

SEQ ID NO: 453169 - DNA, 487 bp, Homo sapiens
  misc_feature: HEFZJCU01CFP3A.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggccatcggtcttcccctggcgccctgctccacggagcacctccgagagcacagcggccctgggctgcctggtcaaggactacttcctacgtgagct

SEQ ID NO: 453170 - DNA, 499 bp, Homo sapiens
  misc_feature: HEFZJCU01AGAYP.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaacgggcccactcggtcttccccctggcaccctcctccaagagcacctctgggggcacagcggccctgggctgcctggtcaaggactacttccgagtagtaca

SEQ ID NO: 453171 - DNA, 525 bp, Homo sapiens
  misc_feature: HEFZJCU01CAZJD.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaacagttatggttgggggagttgggtttttttcgtacttacgggat

SEQ ID NO: 453172 - DNA, 508 bp, Homo sapiens
  misc_feature: HEFZJCU01B0571.21.23.C01.1.454.heavy.3.raw
tcgtcgctcgcacgaccggtgctcgatttagtacacgtgattagggattgggggccccagccctgggattcccagctgtttctgcttgctgatcaggactgcacacagagaactcaccatggagtttgggctgagctgggtttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaaggccccagaactggaactacgccatggacgtctggggcaaac

SEQ ID NO: 453173 - DNA, 405 bp, Homo sapiens
  misc_feature: HEFZJCU01C1YOM.48.61.F06.1.454.heavy.3.raw
agtatacatacacgaccggtgctcgatttagctacgctctaagggaaaggggctggagtgggtggcagtcataccttctgctggaaggaatatctactacgcgggctccgtgaagggccgattcaccatctccagagacaattccaacaagacactgtatctgcaaatgaacagcctgagggctgaagacacggctgtgtattactgtgcgagaggctatcactatggttcggggacttttcagggaaactggctcgacccctggggccagggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 453174 - DNA, 501 bp, Homo sapiens
  misc_feature: HEFZJCU01BUDX7.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgacgagcacagcggcccgtcgggctgcctggtcaggactactccga

SEQ ID NO: 453175 - DNA, 511 bp, Homo sapiens; identical to SEQ ID NO: 448115
  misc_feature: HEFZJCU01D6I1Q.18.39.D06.1.454.heavy.3.raw

SEQ ID NO: 453176 - DNA, 491 bp, Homo sapiens
  misc_feature: HEFZJCU01DNJZU.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccgggaccctggtcaccgtctcctcggcctccaccaagggcccatcggtcttccccctggcgccctgctccaggagcacctccgagagcacagcggccctgggctgcctggtcaaggctacttccctacagtgct

SEQ ID NO: 453177 - DNA, 499 bp, Homo sapiens
  misc_feature: HEFZJCU01CE1XU.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaatctcctgaagctgagctctgtgaccgccgcagacacggctgtctattactgtgcgaggccccgagcgcagtggctttttgatgcctttgatatgtgggccaagggacaatgtcacgt

SEQ ID NO: 453178 - DNA, 521 bp, Homo sapiens
  misc_feature: HEFZJCU01EZ0HL.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactaaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtggggccaagggaccac

SEQ ID NO: 453179 - DNA, 499 bp, Homo sapiens; identical to SEQ ID NO: 447220
  misc_feature: HEFZJCU01CCBM4.12.14.B03.1.454.heavy.3.raw

SEQ ID NO: 453180 - DNA, 379 bp, Homo sapiens; identical to SEQ ID NO: 444450
  misc_feature: HEFZJCU01EK5R4.47.77.G11.1.454.heavy.3.raw

SEQ ID NO: 453181 - DNA, 504 bp, Homo sapiens
  misc_feature: HEFZJCU01CLO3S.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttattgaaacagatggcactacatattattctgactccgtgaagggccgttcaccctctccagagacacttccaacaacatcttgtatcttcacatgcacaatctgagagtcgacgacacggccaccttattattgtgcgcgacatgactacgctcaattctggggccagggacg

SEQ ID NO: 453182 - DNA, 385 bp, Homo sapiens
  misc_feature: HEFZJCU01EFL6M.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaaacgagttctccctggacttgacctctgtgaccgccgcagacacggctgtttattactgtgcgagacgactacctgactccaatccatactttgactattggggccggggagccctggtcaccgtctcctcagcctccaccaagggcccatcggtcttcccctggcgccctgctccaggagcacctccgagagcacagcggccctgggctgcctggtcaaggactacttcccatactcgta

SEQ ID NO: 453183 - DNA, 522 bp, Homo sapiens
  misc_feature: HEFZJCU01C31PJ.11.12.B01.1.454.heavy.3.raw
cgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccg

SEQ ID NO: 453184 - DNA, 507 bp, Homo sapiens
  misc_feature: HEFZJCU01C47S0.40.83.H06.1.454.heavy.3.raw
tctagcgactcacgaccggtgctcgatttagatcacgtgcgtcgcgggggggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtcactgagactctcctgtgcatcgtccggattcacctttagtaccttttggatgacctggatgaacagcctgagacccgaggacgcggctgtgtattactgtgcgagagatgcgaatccgtctgacagcagtggtcgttactatgatgcttttgatatatggggccaagggacaacggtcaccgtctcttcagcctccaccaagggcccatcggtcttcccctggcgccctgctccaggagcacctccgagagcacagcggccctgggctgcctggtacg

SEQ ID NO: 453185 - DNA, 501 bp, Homo sapiens
  misc_feature: HEFZJCU01CQKZK.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaccaattctccctgaagctgagctctgtgaccgccgcagacacggctgtctattactgtgcgaggccccgagcgcagtggcttttgatgcctttgatatgtgggccaagggacaatggtcaccgt

SEQ ID NO: 453186 - DNA, 507 bp, Homo sapiens
  misc_feature: HEFZJCU01CU7JZ.48.81.H04.1.454.heavy.3.raw
agtatacatacacgaccggtgctcgatttagtagtgtagattcgcgggggagcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggagttatcatctactacttt

SEQ ID NO: 453187 - DNA, 518 bp, Homo sapiens; identical to SEQ ID NO: 444718
  misc_feature: HEFZJCU01BUBES.9.34.D01.1.454.heavy.3.raw

SEQ ID NO: 453188 - DNA, 544 bp, Homo sapiens
  misc_feature: HEFZJCU01CM3JF.40.57.F02.1.454.heavy.3.raw
tctagcgactcacgaccggtgctcgatttagctcgatatagttgggtttggggtctgagagaggagcccagccctgggactttcaggtgttttcatttggtgatcaggactgaacagagagacctcaccatggactttgggctgaggtggctttttcttgtggctcttttaaaaggtgtccagtgtgaggtgcagttattggagtcggggggaggcttaatacagccgggggggtccctgagactcgcctgtacagcctctggactcacctttagaaatgatgccttgagctgggtccgccaggctgcagggaaggggctggaatgggtctctattattagtggtaggacagatagtcgaaactacgctgactccgtgaagggccgcttcaccatctccagagacgtttccaacaacacgatctttctggagatgaatagcctgagagccgaggacacggccaaatattactgtgcgaaagaaccctctattgtagtggtggaagttgtaactactactttgattcctggggccagggtaaccc

SEQ ID NO: 453189 - DNA, 393 bp, Homo sapiens
  misc_feature: HEFZJCU01BIKR2.40.20.B09.1.454.heavy.3.raw
tctagcgactcacgaccggtgctcgatttagtgtagtgtgaaggggctggagtgggtctcatccatcagcagtggtagcacttacatacactatgcagactcagtgaagggccgattcaccatctccagagacaacgccgggaactccctgtatctgcaaatgaagagcctgcgagccgaggacacgggtgtttattattgtactaaaggacaagagggactttgggagtactactacggtatggacgtctggggccaagggaccgccgtcaccgtctcctcagcttccaccaagggcccatcggtcttccccctggcgccctgctccaggagcacctctgggggcacagcggccctgggctgcctggtcaaggactacttccagtcgctaga

SEQ ID NO: 453190 - DNA, 482 bp, Homo sapiens
  misc_feature: HEFZJCU01EVMM9.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctcaccaagggcccatcggtcttcccctggcgccctgctccaggagcacctccgagagcacagcggccctgggctgcctggtcaaggactacttcccactactatg

SEQ ID NO: 453191 - DNA, 511 bp, Homo sapiens
  misc_feature: HEFZJCU01D75VW.5.23.C01.1.454.heavy.3.raw
atcagacacgcacgaccggtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaagaggctggagtggattggggagatctatcataccgggagcaccaactacaatccgtccctcaagagtcgagtcaccatatctatagacacgtcgaacaaccagttctccctgaaggtgacctctgtgaccgcgcggacacggccgtctattactgtgcgcggatttcagagggacaggactacgtatatcgacgtctggggcagagggaccacggtcatcgtctcctcagcct

SEQ ID NO: 453192 - DNA, 518 bp, Homo sapiens; identical to SEQ ID NO: 446943
  misc_feature: HEFZJCU01DF4TZ.7.78.H01.1.454.heavy.3.raw

SEQ ID NO: 453193 - DNA, 501 bp, Homo sapiens
  misc_feature: HEFZJCU01DVCE1.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgagtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctgggccagggagcccaggtcaccgtctccccagcctccaccaagggcccatcggtcttccccctggcgccctgctccaggagcacctccgagagcacagcggccctgggctgcctggtcaaggactactcccacta

SEQ ID NO: 453194 - DNA, 405 bp, Homo sapiens
  misc_feature: HEFZJCU01C08FT.12.5.A05.1.454.heavy.3.raw
atacgacgtacacgaccggtgctcgatttagatagatagacagggcaggctccaggcaaggggctggactgggtggccgttatagcacctgatggcaatgtgaagtattatgcagactccgtgaggggccgattcacgatcttaagagacaattcgaagaacactctgtatctacagatggacagcctgagagttgaagacacggctctttattactgtgcgagagagaattacgatttgactctcggtgctcttgatatctggggcctagggacaatggtcaccgtctcctcagcctccaccaagggcccatcggtcttccccctggcgccctgctccaggagcacctccgagagcacagcggccctgggctgccctggtcaaggactacttcctacgtcgtat

SEQ ID NO: 453195 - DNA, 514 bp, Homo sapiens
  misc_feature: HEFZJCU01BB59X.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactcgtggtcaccgtct

SEQ ID NO: 453196 - DNA, 506 bp, Homo sapiens
  misc_feature: HEFZJCU01EGYQG.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgcgagcgacccggggctcctcaatggctttcattacg

SEQ ID NO: 453197 - DNA, 332 bp, Homo sapiens; identical to SEQ ID NO: 446898
  misc_feature: HEFZJCU01EX1GX.12.71.G05.1.454.heavy.3.raw

SEQ ID NO: 453198 - DNA, 499 bp, Homo sapiens
  misc_feature: HEFZJCU01CV502.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaggtgacgtac

SEQ ID NO: 453199 - DNA, 510 bp, Homo sapiens; identical to SEQ ID NO: 445542
  misc_feature: HEFZJCU01CMHGL.16.21.B10.1.454.heavy.3.raw

SEQ ID NO: 453200 - DNA, 507 bp, Homo sapiens
  misc_feature: HEFZJCU01C0W7I.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggtccgcggtccgggt

SEQ ID NO: 453201 - DNA, 494 bp, Homo sapiens
  misc_feature: HEFZJCU01DNJSA.49.4.A04.1.454.heavy.3.raw
agtcgagagacacgaccggtgctcgatttagagtagtgatcagggggggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtgggtggcatttatctcatatgatggaagcaagatatactacattgactccgtgaagggccgattcatcatctccagagacaactccgagaacacactgtatcttcaaatgaacaggttgagagctgaagacacggctttatattactgtgcgaacttaatcacggaggacaacggtccg

SEQ ID NO: 453202 - DNA, 490 bp, Homo sapiens
  misc_feature: HEFZJCU01CGPFB.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgcctgctccaggagcacctccgagagcacagcggccctgggctgcctggtcaaggactacttccgtatctctcg

SEQ ID NO: 453203 - DNA, 519 bp, Homo sapiens; identical to SEQ ID NO: 445330
  misc_feature: HEFZJCU01BTQRQ.7.78.H01.1.454.heavy.3.raw

SEQ ID NO: 453204 - DNA, 396 bp, Homo sapiens; identical to SEQ ID NO: 444469
  misc_feature: HEFZJCU01CYSKV.47.46.E02.1.454.heavy.3.raw

SEQ ID NO: 453205 - DNA, 512 bp, Homo sapiens
  misc_feature: HEFZJCU01CNMN2.12.25.C03.1.454.heavy.3.raw
atacgacgtacacgaccggtgctcgatttagtagtgtagatttgggtttggggaacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatggggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggactctggtcacgtct

SEQ ID NO: 453206 - DNA, 548 bp, Homo sapiens
  misc_feature: HEFZJCU01C7UFU.48.3.A03.1.454.heavy.3.raw
agtatacatacacgaccggtgctcgatttagagagcgtcacagggggagagaggagcccagccctgggattttcaggtgttttcacttggtgatcaggactgaacagagagaactcaccatggagtttgggctgagctggctttttcttctggccattttaaaaggtgtccagtgtgaggagcagttgtcggaatctgggggagacctggtacagccgggggggtccctgacactctcctgtgtggcctctggattcatttttagcaaccacgccattacctgggtccgccagagtccagggaagggactggacggagtcgcgggtataagtggttttagtggaagtagattatacgcagagtccgtaaggggccggttcaccatctccagagacaattccaagaacacggcatatctacaaatgaacaacctgggcgccgaagacacggccgtctattactgtgcgagatcctctactagtgccgcgaggtactttgaactctggggtcagggaaccctggtcaccgtctcctcagcctccaccaac

SEQ ID NO: 453207 - DNA, 393 bp, Homo sapiens
  misc_feature: HEFZJCU01A5P3A.7.60.F05.1.454.heavy.3.raw
cgtgtctctacacgaccggtgctcgatttagtacgtcatcagggaaaggggctgggagtgggtctcagtgatttatagtagttccagttcatttcacgcagactccgtgaagggccgattcaccatctccagagacatttccaagaacacggtggatcttcagatggacagcctcagagcggaggacacggctgtctattactgtgtgagaggcgccaccgtggggatggaaacgattttcttgtttgtctggggccagggaaccctggtcaccgtctcctcagcctccaccaagggcccatcggtcttccccctggcgccctgctccaggagcacctccgagagcacagcggccctgggctgcctggtcaaggactacttcctagagacacg

SEQ ID NO: 453208 - DNA, 526 bp, Homo sapiens
  misc_feature: HEFZJCU01BJXWV.48.87.H10.1.454.heavy.3.raw
agtatacatacacgaccggtgctcgatttagcagtactgcgttgggtttggggagtgactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgttacacacaccatcttgacgactggggatgcttttcatttctggggccaggggaccgtggtcgccgtgtctacagcctccaccaagggcccatcggtcttcccctc

SEQ ID NO: 453209 - DNA, 519 bp, Homo sapiens
  misc_feature: HEFZJCU01AFG3W.53.58.F03.1.454.heavy.3.raw
cgcgtatacacacgaccggtgctcgatttagtctgatcgagaagggaaaggggatactttctgagagtcctggacctcctgtgcaagaacatgaaacatctgtggttcttccttctcctggtggcagctcccagatgggtcctgtcccaggtgcagctgcaggagtcgggcccaggactggtgaagccttcggagaccctgtccctcacctgcactgtctctgttggctccatcattcattatttctggagctgggtccggcagcccccagggaagggactggagtggattgggtatgtctattacaccgggaccacccactacaacccctccctcaagagtcgagtcaccatatcagtagacacgtccaggaaccagttctccctgaagctgagctctgcgaccgctgcgacacggccgtgtattattgtgcgagagttagatttgatactggtgcagccgtacgggggtcctggttcgacccctggggccatggaaccctggtcaccgtctcctcag

SEQ ID NO: 453210 - DNA, 477 bp, Homo sapiens
  misc_feature: HEFZJCU01AHEYR.16.10.A10.1.454.heavy.3.raw
tgtactactccacgaccggtgctcgatttagcgtcgatctcaggggtccctgagactctcctgtgcagcctctggattcacccctagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 453211 - DNA, 384 bp, Homo sapiens; identical to SEQ ID NO: 444454
  misc_feature: HEFZJCU01EC93K.11.61.F06.1.454.heavy.3.raw

SEQ ID NO: 453212 - DNA, 480 bp, Homo sapiens; identical to SEQ ID NO: 445011
  misc_feature: HEFZJCU01ADDLH.22.36.D03.1.454.heavy.3.raw

SEQ ID NO: 453213 - DNA, 494 bp, Homo sapiens
  misc_feature: HEFZJCU01CZEMM.53.26.C04.1.454.heavy.3.raw
cgcgtatacacacgaccggtgctcgatttagtctagcgactttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccggggacagggccatcagaacagcctacatggagctgaacagactgacatctgacgacacggccgtttattattgtgtgagagaggacccgatgacctcgg

SEQ ID NO: 453214 - DNA, 487 bp, Homo sapiens
  misc_feature: HEFZJCU01CHGWE.18.70.G04.1.454.heavy.3.raw
tacgagtatgcacgaccggtgctcgatttagtgtagtgtgaagggaaaggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcaccctcctccaagagcacctctgggggcacagcggccctgggctgcctggtcaggactacttcccatactcgta

SEQ ID NO: 453215 - DNA, 509 bp, Homo sapiens
  misc_feature: HEFZJCU01CJYCR.16.21.B10.1.454.heavy.3.raw
  modified_base (376)..(376): a, c, t, g, unknown or other
tgtactactccacgaccggtgctcgatttagtgtcgtcgcaggagagaggagcccagccctgggattttcaggtgttttcatttggtgatccggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttnaccatctccagagacaattccaagaacacactgtatctgcaatgaacagcctgagagccgacgacacggccatatattactgtgcgaaagcaccggcagttagtcaccatactactttgactactggggccac

SEQ ID NO: 453216 - DNA, 511 bp, Homo sapiens
  misc_feature: HEFZJCU01C2LRB.40.68.G02.1.454.heavy.3.raw
tctagcgactcacgaccggtgctcgatttagtcgatagtgaagggaaaggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaaggcccac

SEQ ID NO: 453217 - DNA, 522 bp, Homo sapiens
  misc_feature: HEFZJCU01AHUPA.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaaccgttactacgctatggacgtcgtcggggccaagggacccg

SEQ ID NO: 453218 - DNA, 494 bp, Homo sapiens
  misc_feature: HEFZJCU01BCH6E.48.23.C01.1.454.heavy.3.raw
agtatacatacacgaccggtgctcgatttagtacacgtgattagggattggggacccaacaaccacatccctcctcagaagcccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcacaacctacactatgcattgggtgcgccaggcccccggacaaagccttgagtggatggggtggctcaacgctggcgatggtcagacaaagtattcacagaagttccagggcagagtcaccatcaccagggacacgtccgcgagtagtgtcttcatggagctgcgcagtctgagatcggaagacacggcagtatattactgtgcgagaggcggatattgtcgtcgaggtgactgctacagtcaaaat

SEQ ID NO: 453219 - DNA, 437 bp, Homo sapiens; identical to SEQ ID NO: 447018
  misc_feature: HEFZJCU01CLP3N.40.27.C05.1.454.heavy.3.raw

SEQ ID NO: 453220 - DNA, 507 bp, Homo sapiens
  misc_feature: HEFZJCU01A0MS5.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggaccacctccacaaaccaggtcggtccttacaatgaccaatatggaccctgtggacacagccacatattactgttcacgctctatggttcggggagttattagtccctactttgactactggggccagggaactctggtcaccgtctccgcagcctccacc

SEQ ID NO: 453221 - DNA, 489 bp, Homo sapiens
  misc_feature: HEFZJCU01BT4RJ.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctgcgccctgctccaggagcacctccgagagcacagccggccctgggctgcctggtcaaggactacttcctacgtgagct

SEQ ID NO: 453222 - DNA, 519 bp, Homo sapiens
  misc_feature: HEFZJCU01D9FFM.49.37.D04.1.454.heavy.3.raw
agtcgagagacacgaccggtgctcgatttagtagcatactgttgggtttggggttgaagtgaagaagcctggggcctcggtgaaggtttcctgcaaggcatctggatacagcttgaccaactactatatacagtgggtgcgacaggcccctggacaagggcttgagtggatgggaagaatcaaccctaatgatggaagtacaacaaacgcgcagaaatttcagggcagaataaccctgaccagggacacgtccacgagcacagtctacatggaattgagcagcctgagatctgaagacacggccgtctattactgtgccagagaatatcgttttatagtgggagctgccccacgatcgccattccactttgactactggggccagggaacactggtcaccgtctcctcagcctccaccaagggcccatcggtcttccccctggcaccctcctccaagagcacctctgggggcacagcggccctgggctgcctggtcaaggactacttcctctctcgact

SEQ ID NO: 453223 - DNA, 519 bp, Homo sapiens; identical to SEQ ID NO: 445330
  misc_feature: HEFZJCU01BINPM.7.78.H01.1.454.heavy.3.raw

SEQ ID NO: 453224 - DNA, 498 bp, Homo sapiens
  misc_feature: HEFZJCU01EVS0A.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgctttgatatctgggccaagggac

SEQ ID NO: 453225 - DNA, 512 bp, Homo sapiens
  misc_feature: HEFZJCU01CW037.47.55.E11.1.454.heavy.3.raw
agctcacgtacacgaccggtgctcgatttagcactcgcacgttgggtttggggagccgcagccctcgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgcttcggtccgcgggacttctggggcctagggaacccg

SEQ ID NO: 453226 - DNA, 520 bp, Homo sapiens
  misc_feature: HEFZJCU01D9HQH.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttatactgttcgagacatgccgaccgagagcattatcggcagtacggttttgattatttggggccaagggacaagggtcaccgtctccgcagcctcaaccg

SEQ ID NO: 453227 - DNA, 503 bp, Homo sapiens; identical to SEQ ID NO: 445995
  misc_feature: HEFZJCU01CGC47.17.25.C03.1.454.heavy.3.raw

SEQ ID NO: 453228 - DNA, 314 bp, Homo sapiens; identical to SEQ ID NO: 444774
  misc_feature: HEFZJCU01DHKG1.7.10.A10.1.454.heavy.3.raw

SEQ ID NO: 453229 - DNA, 507 bp, Homo sapiens
  misc_feature: HEFZJCU01A08W4.52.86.H09.1.454.heavy.3.raw
cgcagtacgacacgaccggtgctcgatttagtgctatagacttgggtttggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctccaagagcacctctgggggcacagcggccctgggctgcctggtcaaggactacttccta

SEQ ID NO: 453230 - DNA, 532 bp, Homo sapiens
  misc_feature: HEFZJCU01A1X4O.51.35.D02.1.454.heavy.3.raw
cgatcgtatacacgaccggtgctcgatttagcacacgatagttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaagggcccatcggtcttccccctggcaccctcctccaagagcacctcg

SEQ ID NO: 453231 - DNA, 493 bp, Homo sapiens
  misc_feature: HEFZJCU01DAY50.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtgctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaggacta

SEQ ID NO: 453232 - DNA, 523 bp, Homo sapiens
  misc_feature: HEFZJCU01CQVN7.13.33.C11.1.454.heavy.3.raw
tcacgtactacacgaccggtgctcgatttagagtgagctcgttgggtttggggatgctttctgagagtcatggatctcatttgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggagttcgactactggggccagggaaccctggtcaccgtctctcagcctccaccaagggccc

SEQ ID NO: 453233 - DNA, 525 bp, Homo sapiens; identical to SEQ ID NO: 447753
  misc_feature: HEFZJCU01EXFY8.16.27.C05.1.454.heavy.3.raw

SEQ ID NO: 453234 - DNA, 521 bp, Homo sapiens
  misc_feature: HEFZJCU01D5ND9.12.27.C05.1.454.heavy.3.raw
atacgacgtacacgaccggtgctcgatttagacgcgatcgaagggtttggggtctgagagaggagcccagccctgggattttcaggtgttttcatttggtgatcaggactgaacagagagaactcaccatggagtttgggctgagctggtctttttcttgtggctaattttaaaaggtgtccagtgtgaggtgcaactggtggagtcgtgggggaggcttggtacaggccggggggtccctgagactctcctgtgcaggctctggattcatctttaacaactatgccatgagctgggtccgccaggctccagggaaggggctggagtgggtctcagctattagtaatagtggtgatagcacatcctacgcagactccgtgaagggccgcttcaccatctccagagacaattccaagaacacgctgtatctaccaaatgaacagtctcagagaccgaggacacggccatatattactgtgacgaaagacacagccgctagtttggggggagtcatcgtcctt

SEQ ID NO: 453235 - DNA, 513 bp, Homo sapiens
  misc_feature: HEFZJCU01B7ZV7.9.70.G04.1.454.heavy.3.raw
tgatacgtctcacgaccggtgctcgatttagtgtagtgtgaagggaaagggcctgtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcttactacggtctggacgtctggggccaggggaccaaggtcaccgtctcctcagcctccaccaagggcccatcggtcttcccctggcgccctgctccaggagcacctccgagagcacagcggcctgggctgcctggtcaaggactacttccagacgtatca

SEQ ID NO: 453236 - DNA, 523 bp, Homo sapiens; identical to SEQ ID NO: 446270
  misc_feature: HEFZJCU01EP99O.12.40.D07.1.454.heavy.3.raw

SEQ ID NO: 453237 - DNA, 530 bp, Homo sapiens
  misc_feature: HEFZJCU01BNRB1.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagccctccaccaacgggcccagtcggtccttcccctggccgccctgcctccaggagccaccctccgagagccacagccggccc

SEQ ID NO: 453238 - DNA, 500 bp, Homo sapiens
  misc_feature: HEFZJCU01AWJNF.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaaggcccatcggtcttcccctggcgccctgctccaggagcacctccgagagcacagcggccctgggctgcctggtcaaggactacttcctatgtatact

SEQ ID NO: 453239 - DNA, 487 bp, Homo sapiens
  misc_feature: HEFZJCU01DPPO3.48.20.B09.1.454.heavy.3.raw
agtatacatacacgaccggtgctcgatttagtgtagtgtgaagggggggcctggtaccgcctggggggtcccttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaaggccatcggtcttcccctggcgccctgctccaggagcacctccgagagcacagcggccctgggctgcctggtcaaggactacttcctatgtatact

SEQ ID NO: 453240 - DNA, 496 bp, Homo sapiens
  misc_feature: HEFZJCU01EPZXG.22.86.H09.1.454.heavy.3.raw
acatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccctggcgccctgctccaggagcacctccgagagcacagcggccctgggctgcctggtcaaggactacttccagacgtatca

SEQ ID NO: 453241 - DNA, 521 bp, Homo sapiens
  misc_feature: HEFZJCU01ES5Z1.12.58.F03.1.454.heavy.3.raw
atacgacgtacacgaccggtgctcgatttagtctgatcgagaagggaaagggggcagagaggagccttagccctggactccaaggcctttccacttggtgatcagcactgagcacagaggactcaccatggaattggggctgagctgggttttccttgttgctattttagaaggtgtccagtgtgagggacaattggtggagtctgggggaggcttggtccagccggggggtccctgagactctcctgtacagcctctggattcactctcggaaacttttggatggtctgggtccgccaggctccagggaaggggctggagtgggtggccaatatacagtcaggtggaggtacgatacactatctcgactctgtgaagggccggttcaccatctccagagacaacgccaagaattcactgtatctgcaaatgaacagcctgagagtcgaaagacacgggtatttattattgtgtgcgagatctggtatttccttcgaaatgaagtgtggtcgatgtgtttg

SEQ ID NO: 453242 - DNA, 496 bp, Homo sapiens; identical to SEQ ID NO: 444697
  misc_feature: HEFZJCU01AZ4WS.16.37.D04.1.454.heavy.3.raw

SEQ ID NO: 453243 - DNA, 532 bp, Homo sapiens
  misc_feature: HEFZJCU01AC4HB.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcacgcctccaccaaggg

SEQ ID NO: 453244 - DNA, 481 bp, Homo sapiens; identical to SEQ ID NO: 445006
  misc_feature: HEFZJCU01EG74L.7.10.A10.1.454.heavy.3.raw

SEQ ID NO: 453245 - DNA, 500 bp, Homo sapiens; identical to SEQ ID NO: 446033
  misc_feature: HEFZJCU01DI9I4.11.27.C05.1.454.heavy.3.raw

SEQ ID NO: 453246 - DNA, 461 bp, Homo sapiens
  misc_feature: HEFZJCU01ES8YR.10.77.G11.1.454.heavy.3.raw
catagtagtgcacgaccggtgctcgatttagctagtcactcaagggaaagggtgtacacctgtggttctcggggctgccctttggctttggagatggttttctcgaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggacgtctggggccaagggaccacggtcaccgtctcctcagcctccaccaagggcccatcggtcttccccctggcaccctcctccaagagcacctctgggggcacagcggccctgggctgcctggtcaaggactacttcccactactatg

SEQ ID NO: 453247 - DNA, 479 bp, Homo sapiens; identical to SEQ ID NO: 447128
  misc_feature: HEFZJCU01EIOIL.4.37.D04.1.454.heavy.3.raw

SEQ ID NO: 453248 - DNA, 502 bp, Homo sapiens; identical to SEQ ID NO: 451203
  misc_feature: HEFZJCU01D5KPZ.10.38.D05.1.454.heavy.3.raw

SEQ ID NO: 453249 - DNA, 327 bp, Homo sapiens
  misc_feature: HEFZJCU01CFFBM.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttttgtgtcgaaggacacgatttggggccgcatgaacttccacttttgactattggggccagggagcccgtggtcaccgtctcctcagcctccaccaagggcccatcggtcttccccctggcgccctgctccaggagcacctccgagagcacagcggccctgggctgcctggtcaaggactacttcccatactcgta

SEQ ID NO: 453250 - DNA, 507 bp, Homo sapiens
  misc_feature: HEFZJCU01BSTHN.48.44.D11.1.454.heavy.3.raw
agtatacatacacgaccggtgctcgatttagcgcagtacgaaggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatcgtatact

SEQ ID NO: 453251 - DNA, 524 bp, Homo sapiens
  misc_feature: HEFZJCU01CE1NT.17.42.D09.1.454.heavy.3.raw
cgtagactagcacgaccggtgctcgatttagacacatacgcagggaaaggggtgggcggcaactatgcaaatgcaagtgggggcctctccacttaaacccagggctcccctccacagtgagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaagcccggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctggcaagtccatcagtactgccttcctgccagtggcgcagccctgggacggccgtcggaccacccggcctatattaa

SEQ ID NO: 453252 - DNA, 508 bp, Homo sapiens
  misc_feature: HEFZJCU01BTPFQ.51.5.A05.1.454.heavy.3.raw
cgatcgtatacacgaccggtgctcgatttagatagatagacagggggctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtcccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtcctgcacctcgtgtggcccaatttggtttaccggcacgacaaatcagggcaagtcctacgacggtctgg

SEQ ID NO: 453253 - DNA, 515 bp, Homo sapiens
  misc_feature: HEFZJCU01EXKD3.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggccatatattactgtgcgagagattggggccgacggaaaccttgactacgtggggccaggggaaccctggtcaccggt

SEQ ID NO: 453254 - DNA, 394 bp, Homo sapiens; identical to SEQ ID NO: 444701
  misc_feature: HEFZJCU01CUJOA.3.12.B01.1.454.heavy.3.raw

SEQ ID NO: 453255 - DNA, 500 bp, Homo sapiens; identical to SEQ ID NO: 448262
  misc_feature: HEFZJCU01ET1ZE.7.85.H08.1.454.heavy.3.raw

SEQ ID NO: 453256 - DNA, 500 bp, Homo sapiens; identical to SEQ ID NO: 445720
  misc_feature: HEFZJCU01CMHSZ.3.20.B09.1.454.heavy.3.raw

SEQ ID NO: 453257 - DNA, 508 bp, Homo sapiens
  misc_feature: HEFZJCU01DK3I9.4.67.G01.1.454.heavy.3.raw
  modified_base (482)..(482): a, c, t, g, unknown or other
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagntctcgggctggttccgcggtccgggt

SEQ ID NO: 453258 - DNA, 378 bp, Homo sapiens
  misc_feature: HEFZJCU01B1EW7.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctccgagagcacagcgccctgggctgcctggtcaaggactacttcctacgtgagct

SEQ ID NO: 453259 - DNA, 511 bp, Homo sapiens
  misc_feature: HEFZJCU01BYV2G.12.55.E11.1.454.heavy.3.raw
  modified_base (436)..(436): a, c, t, g, unknown or other
  modified_base (503)..(503): a, c, t, g, unknown or other
atacgacgtacacgaccggtgctcgatttagcactcgcacgttgggtttgggctgagcgtggtttcgtcgttaggctctttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaagggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcnccctggtcactgtctcctcggcttccaccagggcccatcggtcttcccctggcgccctgctccaggngcacctcg

SEQ ID NO: 453260 - DNA, 315 bp, Homo sapiens; identical to SEQ ID NO: 444422
  misc_feature: HEFZJCU01BRO6W.47.84.H07.1.454.heavy.3.raw

SEQ ID NO: 453261 - DNA, 508 bp, Homo sapiens; identical to SEQ ID NO: 446002
  misc_feature: HEFZJCU01A8PUF.9.78.H01.1.454.heavy.3.raw

SEQ ID NO: 453262 - DNA, 522 bp, Homo sapiens
  misc_feature: HEFZJCU01A1LNU.10.53.E09.1.454.heavy.3.raw
catagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaagtaccttcagcactggggccagggcaccctggtcaccgtctcctcagcctccaccaagggcccatcggtcttcccctggcacctcctccagagcacctctgggggcacagcggccctgggctgcct

SEQ ID NO: 453263 - DNA, 551 bp, Homo sapiens
  misc_feature: HEFZJCU01BRELQ.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaaggagggggatacagtggcagctccaagtactactttgacttcgtggggccagggaaccctggtcaccgtctcctcacgcctccaccgaacgggcccacgtccggttccttcccccgtcggccgccctcgcctccgagggacgccgaccctcccgaagacg

SEQ ID NO: 453264 - DNA, 324 bp, Homo sapiens; identical to SEQ ID NO: 444475
  misc_feature: HEFZJCU01DFUXN.18.17.B06.1.454.heavy.3.raw

SEQ ID NO: 453265 - DNA, 396 bp, Homo sapiens; identical to SEQ ID NO: 444469
  misc_feature: HEFZJCU01A6SQ7.47.46.E02.1.454.heavy.3.raw

SEQ ID NO: 453266 - DNA, 508 bp, Homo sapiens
  misc_feature: HEFZJCU01D1YKL.12.30.C08.1.454.heavy.3.raw
atacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtccccagggaagggcctggagtggattgggtacatctatcacagtgggagcacctactacatcccgtccctgaagagtcgaattacgatgtcagtaaacacgtctaggaaccagttctccctgaagctgaggtctgtgactgccgcagacacggccgtctactactgtgccagggtgggctttgcgccagtggttcagagatgatcgcttcgattcgtggggccagggaattcg

SEQ ID NO: 453267 - DNA, 505 bp, Homo sapiens
  misc_feature: HEFZJCU01AV2GM.13.55.E11.1.454.heavy.3.raw
tcacgtactacacgaccggtgctcgatttagcactcgcacgttgggtttggggggtctcagagaggagccttagccctggactccaaggcctttccacttggtgatcagcactgagcacagaggactcaccatggaattggggctgagctgggtgctccttgttgctattttagaaggtggccagtgtgagatgcgactggtggagtctgggggaggcttggtccagccgggggggtcactgagactctcctgtacagcctcgagattcattttcaggaattattggatgagttgggtccgccagtctccagggaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgacagttttccagacggacg

SEQ ID NO: 453268 - DNA, 519 bp, Homo sapiens; identical to SEQ ID NO: 446228
  misc_feature: HEFZJCU01AXHL9.9.43.D10.1.454.heavy.3.raw

SEQ ID NO: 453269 - DNA, 524 bp, Homo sapiens; identical to SEQ ID NO: 446401
  misc_feature: HEFZJCU01BZRZX.3.82.H05.1.454.heavy.3.raw

SEQ ID NO: 453270 - DNA, 391 bp, Homo sapiens; identical to SEQ ID NO: 444514
  misc_feature: HEFZJCU01CMIUP.12.24.C02.1.454.heavy.3.raw

SEQ ID NO: 453271 - DNA, 513 bp, Homo sapiens; identical to SEQ ID NO: 446699
  misc_feature: HEFZJCU01CZNAX.12.25.C03.1.454.heavy.3.raw

SEQ ID NO: 453272 - DNA, 488 bp, Homo sapiens
  misc_feature: HEFZJCU01EQMWR.18.70.G04.1.454.heavy.3.raw
  modified_base (86)..(86): a, c, t, g, unknown or other
tacgagtatgcacgaccggtgctcgatttagtgtagtgtgaagggaaagggggaagaggaagactgacggtcctgccacaggtggngctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctgggctgcctggtcaggactacttcccatactcgta

SEQ ID NO: 453273 - DNA, 523 bp, Homo sapiens
  misc_feature: HEFZJCU01DRN6K.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctgggccaaggtacagcggtcaccgtcgcctcagcctccaccaagggcccatcggtcttccccctcggccaccctcctccaagacgcacctctggggggcacac

SEQ ID NO: 453274 - DNA, 400 bp, Homo sapiens; identical to SEQ ID NO: 444452
  misc_feature: HEFZJCU01AF4AP.47.24.C02.1.454.heavy.3.raw

SEQ ID NO: 453275 - DNA, 431 bp, Homo sapiens
  misc_feature: HEFZJCU01CGZVU.11.39.D06.1.454.heavy.3.raw
cgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaagggcccatcggtcttcccctggcaccctcctccaagagcacctctgggggcacagcggccctgggctgcctggtcaaggactacttccgtatctctcg

SEQ ID NO: 453276 - DNA, 504 bp, Homo sapiens
  misc_feature: HEFZJCU01EIZI9.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaaggggacaat

SEQ ID NO: 453277 - DNA, 518 bp, Homo sapiens; identical to SEQ ID NO: 444718
  misc_feature: HEFZJCU01D12FG.9.34.D01.1.454.heavy.3.raw

SEQ ID NO: 453278 - DNA, 519 bp, Homo sapiens
  misc_feature: HEFZJCU01BG79Y.16.86.H09.1.454.heavy.3.raw
  modified_base (496)..(496): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctcgatagcagtggctggtccactaggtttgactactgggggccagggancttggtcaccgtctcctcagcct

SEQ ID NO: 453279 - DNA, 486 bp, Homo sapiens
  misc_feature: HEFZJCU01AU3LN.12.40.D07.1.454.heavy.3.raw
  modified_base (426)..(426): a, c, t, g, unknown or other
atacgacgtacacgaccggtgctcgatttagtgatagagcgtaacaacagaggactcaccatggagtttgggctgagcgtgggttttcctcgttgctcttttaagaggtgtccagtgtcaggggcacctggtggagtctggggctctgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggagccaggggaccctggtcatcgtctccccagcctccaccaagggcccatcggtcttccccctggcgccctgctccaggngcacctccgagagcacagcggccctgggctgcctggtcaggactacttcctacgtcgtat

SEQ ID NO: 453280 - DNA, 313 bp, Homo sapiens; identical to SEQ ID NO: 445488
  misc_feature: HEFZJCU01BCYCH.49.8.A08.1.454.heavy.3.raw

SEQ ID NO: 453281 - DNA, 491 bp, Homo sapiens; identical to SEQ ID NO: 444592
  misc_feature: HEFZJCU01DWGAT.11.26.C04.1.454.heavy.3.raw

SEQ ID NO: 453282 - DNA, 533 bp, Homo sapiens
  misc_feature: HEFZJCU01AIBYN.12.12.B01.1.454.heavy.3.raw
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtggattgggagtatctattttagcgggagcacctaccagaacgcgtccctcaagagtcgaatcaccatgtcggtggacacatcgaagaaccagatctcccttaagttgaggtctgtgaccgccgctgacacggccgtctattactgtgcgagagtccgtgctggaagaacactttttttgactattggggccagggaatcctggtcaccgtcgcctcagcctccaccaagggcccatccggtcttccccc

SEQ ID NO: 453283 - DNA, 497 bp, Homo sapiens
  misc_feature: HEFZJCU01ER60P.51.3.A03.1.454.heavy.3.raw
cgatcgtatacacgaccggtgctcgatttagagagcgtcacaggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaagctttgagtggatgggatggatcaccgctggcaatggtgacacaaaatattcacagaagttccagggcagagtcaccattaacagggacacatctgcgagtacaggctacatggaactgagcggcctgagatctgaggacacggctatttattactgtgcgagagggaagtgggatattgtggcagctccaggtgcccagccggccccttacg

SEQ ID NO: 453284 - DNA, 504 bp, Homo sapiens
  misc_feature: HEFZJCU01DGSHQ.14.21.B10.1.454.heavy.3.raw
cgtctagtaccacgaccggtgctcgatttagtgtcgtcgcaggagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagtattttggagtggttattatacctttgactc

SEQ ID NO: 453285 - DNA, 476 bp, Homo sapiens; identical to SEQ ID NO: 448842
  misc_feature: HEFZJCU01CAY2Z.16.10.A10.1.454.heavy.3.raw

SEQ ID NO: 453286 - DNA, 379 bp, Homo sapiens; identical to SEQ ID NO: 444450
  misc_feature: HEFZJCU01EPBS9.47.77.G11.1.454.heavy.3.raw

SEQ ID NO: 453287 - DNA, 487 bp, Homo sapiens
  misc_feature: HEFZJCU01A1AFD.10.55.E11.1.454.heavy.3.raw
catagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatgggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacatcac

SEQ ID NO: 453288 - DNA, 477 bp, Homo sapiens; identical to SEQ ID NO: 444659
  misc_feature: HEFZJCU01AR6DX.16.10.A10.1.454.heavy.3.raw

SEQ ID NO: 453289 - DNA, 383 bp, Homo sapiens
  misc_feature: HEFZJCU01ASEC0.11.61.F06.1.454.heavy.3.raw
cgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttcccctggcgccctgctccaggagcacctccgagagcacagcggccctgggctgcctggtcaaggactacttccgtatctctcg

SEQ ID NO: 453290 - DNA, 494 bp, Homo sapiens
  misc_feature: HEFZJCU01AMFGC.22.52.E08.1.454.heavy.3.raw
acatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggctttttcttgtggctattttaaaaggtgtccagtgtgaggtgcagctggtggagtctgggggaggcttggtacagcctggggggtccctgagactctcctgtgcagcctctggattcacctttagcaattatgccatgagctgggtccgccaggctccagggaaggggctggagtgggtctcagctgttagtggtggtgatggtggcacatactacgcagactccgtgaagggccggttcaccatctccagagacaattccaagaacaccctatatatgcaaatgaacagcctgagagccgaagacacggccgtatactactgtgcgaagggcgtgatagcagc

SEQ ID NO: 453291 - DNA, 523 bp, Homo sapiens
  misc_feature: HEFZJCU01DAI7A.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctgggccgt

SEQ ID NO: 453292 - DNA, 513 bp, Homo sapiens
  misc_feature: HEFZJCU01CFYE2.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtcccgtgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctcggcgccctgctccaggagcacctccgacgagcacagcggccctgg

SEQ ID NO: 453293 - DNA, 518 bp, Homo sapiens
  misc_feature: HEFZJCU01EJ2V3.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctggctgcctggtcaaggactacttccagacgtatca

SEQ ID NO: 453294 - DNA, 535 bp, Homo sapiens
  misc_feature: HEFZJCU01CNIDF.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggctttcatgtctgggccaagggacgctggtcaccgtctcttcagcctccaccaagggcccatcggtcttcccctggcaccctcctccaagagcacctctgggggcacagcc

SEQ ID NO: 453295 - DNA, 499 bp, Homo sapiens
  misc_feature: HEFZJCU01BS0NV.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaaacgatgcttttgatatgtgggaccg

SEQ ID NO: 453296 - DNA, 463 bp, Homo sapiens; identical to SEQ ID NO: 448983
  misc_feature: HEFZJCU01A0X44.10.85.H08.1.454.heavy.3.raw

SEQ ID NO: 453297 - DNA, 488 bp, Homo sapiens; identical to SEQ ID NO: 444651
  misc_feature: HEFZJCU01CEYT4.16.67.G01.1.454.heavy.3.raw

SEQ ID NO: 453298 - DNA, 432 bp, Homo sapiens; identical to SEQ ID NO: 444920
  misc_feature: HEFZJCU01B8VTU.11.39.D06.1.454.heavy.3.raw

SEQ ID NO: 453299 - DNA, 514 bp, Homo sapiens
  misc_feature: HEFZJCU01CZPI4.52.78.H01.1.454.heavy.3.raw
cgcagtacgacacgaccggtgctcgatttagtgtgagtagtttgggtttggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaacgggcccatcggtcttcccccgtggccaccctcctccaagagcacctctgggggcacagcggccctgggctgcctggtcaggactacttcctatacg

SEQ ID NO: 453300 - DNA, 516 bp, Homo sapiens
  misc_feature: HEFZJCU01DZ0UK.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggacaatggtcaccgtctcttcagcctccaccaagggcccatcggtcttcccctggccaccctcctccaagagcacctctgggggcacagcggcccg

SEQ ID NO: 453301 - DNA, 506 bp, Homo sapiens
  misc_feature: HEFZJCU01BUYGU.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccaggacagagtcaccctgaccacagagacatccacgaccacagtctacatggagctgtggagcctgagacctgacgacacggccctctattactgtgcgaggccctatcctacagtgaccactccacgctggttcgacctctggggccac

SEQ ID NO: 453302 - DNA, 389 bp, Homo sapiens
  misc_feature: HEFZJCU01D4KNP.48.70.G04.1.454.heavy.3.raw
agtatacatacacgaccggtgctcgatttagtgtagtgtgaagggaaagggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 453303 - DNA, 517 bp, Homo sapiens
  misc_feature: HEFZJCU01BIGYR.49.9.A09.1.454.heavy.3.raw
agtcgagagacacgaccggtgctcgatttagcgagacgcgcagggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggaatcgccttcaataagttttggatgtactgggtccgccaagttccagggaaggggctgatgtgggtctcacgtattgatgttgatgggagttacagtgaccacgcggactctgtgaagggccgattcaccgtctccagagaaaacgccaagaacacggtgtatctgcaaatgactggcctgagagccgaggacacggcagtttattactgtgcaagaggcttgtggtcgactgtcgacctggactggtacttcgatctgtgggcgtggca

SEQ ID NO: 453304 - DNA, 506 bp, Homo sapiens
  misc_feature: HEFZJCU01EBPXM.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtgacgtggtattccggggggacgacatgacaccg

SEQ ID NO: 453305 - DNA, 520 bp, Homo sapiens
  misc_feature: HEFZJCU01BIT85.26.57.F02.1.454.heavy.3.raw
agactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggttcaccatctccagagatgattcagagaacacggcgtatctgcaaatgaacagcctgaaaaccgaggacacggccgtgtattactgtgccagacatccgtcgtattacgtatttttcagtggtcccg

SEQ ID NO: 453306 - DNA, 324 bp, Homo sapiens; identical to SEQ ID NO: 444475
  misc_feature: HEFZJCU01BI2V4.18.17.B06.1.454.heavy.3.raw

SEQ ID NO: 453307 - DNA, 481 bp, Homo sapiens
  misc_feature: HEFZJCU01BQ0KH.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagactttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttccccctggcgccctgctccaggagcacctccgagagcacagcggccctgggctgcctggtcaaggactacttcccacgaggta

SEQ ID NO: 453308 - DNA, 506 bp, Homo sapiens; identical to SEQ ID NO: 444696
  misc_feature: HEFZJCU01C1W2T.16.34.D01.1.454.heavy.3.raw

SEQ ID NO: 453309 - DNA, 521 bp, Homo sapiens; identical to SEQ ID NO: 448417
  misc_feature: HEFZJCU01CGRG2.13.33.C11.1.454.heavy.3.raw

SEQ ID NO: 453310 - DNA, 393 bp, Homo sapiens
  misc_feature: HEFZJCU01D1VLI.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaggactacttcgagtagtaca

SEQ ID NO: 453311 - DNA, 511 bp, Homo sapiens; identical to SEQ ID NO: 445268
  misc_feature: HEFZJCU01CYS5M.48.34.D01.1.454.heavy.3.raw

SEQ ID NO: 453312 - DNA, 403 bp, Homo sapiens; identical to SEQ ID NO: 444658
  misc_feature: HEFZJCU01EPV7W.14.60.F05.1.454.heavy.3.raw

SEQ ID NO: 453313 - DNA, 501 bp, Homo sapiens
  misc_feature: HEFZJCU01B5KMW.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaatgaacaatctgagagtcgacgatacggctgtctatcattgtgtttcgatgccttcggtccgcgggacttctgggccagga

SEQ ID NO: 453314 - DNA, 487 bp, Homo sapiens; identical to SEQ ID NO: 452643
  misc_feature: HEFZJCU01D6RW4.4.6.A06.1.454.heavy.3.raw

SEQ ID NO: 453315 - DNA, 530 bp, Homo sapiens
  misc_feature: HEFZJCU01B8I9A.4.59.F04.1.454.heavy.3.raw
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctccctgaggctgagctctgtgaccgccgcggacacggccgtgtatttctgtgcgagatctttcgatttttggagtggtaaccccttggctactggggccagggaacctggtcaccgtctcttcagcctcaccaagggccctacg

SEQ ID NO: 453316 - DNA, 514 bp, Homo sapiens
  misc_feature: HEFZJCU01BOGG8.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaacccctggtcaccgtctcctcagcttccaccaagggcccatcgtcttcccctggcgccctgctccaggagcacctctggggcacagcggcccg

SEQ ID NO: 453317 - DNA, 506 bp, Homo sapiens
  misc_feature: HEFZJCU01CBFVF.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctagggccaac

SEQ ID NO: 453318 - DNA, 501 bp, Homo sapiens
  misc_feature: HEFZJCU01D3VVG.13.33.C11.1.454.heavy.3.raw
  modified_base (435)..(435): a, c, t, g, unknown or other
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacganacggccgtttattattgtgcaataagaattgcaaacgatgcttttgatatgttgggggccgaaggg

SEQ ID NO: 453319 - DNA, 523 bp, Homo sapiens
  misc_feature: HEFZJCU01BU9HM.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggccgccctgctccaggagcacctccgagagcacagcggcccgt

SEQ ID NO: 453320 - DNA, 509 bp, Homo sapiens
  misc_feature: HEFZJCU01BVGEA.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggcccgtgggctgcctggtcaaggactacttccagacgtatca

SEQ ID NO: 453321 - DNA, 524 bp, Homo sapiens
  misc_feature: HEFZJCU01CG5DK.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccttgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattccaccatctccagagacaactctaagaacacgctgtttcttcaatgaacagcctgagagccgatgacacggccgtgtattactgtgcgagagatggggcccacgaacgttactacgctatggacgtctggggccaagggaccac

SEQ ID NO: 453322 - DNA, 385 bp, Homo sapiens; identical to SEQ ID NO: 444438
  misc_feature: HEFZJCU01A6YQN.18.60.F05.1.454.heavy.3.raw

SEQ ID NO: 453323 - DNA, 528 bp, Homo sapiens
  misc_feature: HEFZJCU01D22EM.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcgggacacgggcgtttattactgtgcgagagggacggactacggtgactactgggggttcgaccccgtggggccagggaaccctggtcaccgtctcctcagcctccaccg

SEQ ID NO: 453324 - DNA, 495 bp, Homo sapiens; identical to SEQ ID NO: 446556
  misc_feature: HEFZJCU01BFZLT.10.71.G05.1.454.heavy.3.raw

SEQ ID NO: 453325 - DNA, 512 bp, Homo sapiens
  misc_feature: HEFZJCU01A9VRN.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttccccctggcgccctgctccaggagcacctctgggggcacagcggccctgggctgcctggtcaaggactacttcccata

SEQ ID NO: 453326 - DNA, 385 bp, Homo sapiens
  misc_feature: HEFZJCU01EBGFJ.47.77.G11.1.454.heavy.3.raw
agctcacgtacacgaccggtgctcgatttagctagtcactcaagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaagggcccatcggtcttccccctggcaccctcctccaagagcacctctgggggcacagcggccctgggctgcctggtcaaggactacttcctacgtgagct

SEQ ID NO: 453327 - DNA, 562 bp, Homo sapiens
  misc_feature: HEFZJCU01BMP0C.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcaccctcggtcgggcacgcggcccgtccgtcggacgtcgtccgttcgtacgaacggtaccttaccgttaccggtaagttacgtaactacgtaggacgggccgggtcggtcggaacggacggcgact

SEQ ID NO: 453328 - DNA, 515 bp, Homo sapiens
  misc_feature: HEFZJCU01AFDV5.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcaaatgaacagcctgagagccgacgacacggccatatattactgtgcgaaagcaccggcagttagtcacccatactactttgactactggggccaac

SEQ ID NO: 453329 - DNA, 527 bp, Homo sapiens
  misc_feature: HEFZJCU01E1XJU.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccaggggggacctttggggtttcgacccctggggccagggaaccctggtcaccgtctcctcagcctccaccaagggcccatccggtcttccccctggcaccctcctccaagagcacctctgggggcacagcc

SEQ ID NO: 453330 - DNA, 512 bp, Homo sapiens
  misc_feature: HEFZJCU01BDADT.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctggggcacagcggccctgggctgcctggtcaaggactacttcccatacc

SEQ ID NO: 453331 - DNA, 503 bp, Homo sapiens
  misc_feature: HEFZJCU01E0YJ8.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggtctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgtcgcgacatgactacgctcaattactggggccg

SEQ ID NO: 453332 - DNA, 505 bp, Homo sapiens
  misc_feature: HEFZJCU01E0F59.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgactttcgtc

SEQ ID NO: 453333 - DNA, 489 bp, Homo sapiens
  misc_feature: HEFZJCU01C1YZL.22.86.H09.1.454.heavy.3.raw
acatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgtaacg

SEQ ID NO: 453334 - DNA, 510 bp, Homo sapiens; identical to SEQ ID NO: 449039
  misc_feature: HEFZJCU01DN2UV.7.28.C06.1.454.heavy.3.raw

SEQ ID NO: 453335 - DNA, 502 bp, Homo sapiens
  misc_feature: HEFZJCU01EKZKF.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacaagggcagagtcaccattaccagggacacatccgcgaacacagcctacatggagctgagcagcctgacatctgaagacacggctgtgtattactgttcgagacggctagtctgggatctagttatagtgactcgtcgttctggggccg

SEQ ID NO: 453336 - DNA, 519 bp, Homo sapiens
  misc_feature: HEFZJCU01ERQYT.9.34.D01.1.454.heavy.3.raw
tgatacgtctcacgaccggtgctcgatttagatcgtctgtgttgagtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcatcagcctccaccaagggcccatcggtcttcccctggcaccctcctccaagagcacctctgggggcacagcggccctgggctgcctggtcaaggactacttccagacgtatcac

SEQ ID NO: 453337 - DNA, 484 bp, Homo sapiens; identical to SEQ ID NO: 445876
  misc_feature: HEFZJCU01DCTF2.8.39.D06.1.454.heavy.3.raw

SEQ ID NO: 453338 - DNA, 505 bp, Homo sapiens
  misc_feature: HEFZJCU01DVHEW.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtcgcgggacttctggggccagggaa

SEQ ID NO: 453339 - DNA, 480 bp, Homo sapiens
  misc_feature: HEFZJCU01DH0EO.53.33.C11.1.454.heavy.3.raw
cgcgtatacacacgaccggtgctcgatttagagtgagctcgttgggtttgggggctctgggagacgagcccagcactggaagtcgccggtgtttccattcggtgatcatcactgaacacagaggactcaccatggagtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcga

SEQ ID NO: 453340 - DNA, 379 bp, Homo sapiens
  misc_feature: HEFZJCU01DSSM6.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcagcgtctcctcagcctccaccaagggcccatcggtcttccccctggcgccctgctccaggagcacctccgagagcacagcggccctgggctgcctggtcaaggactacttcctacgtgagct

SEQ ID NO: 453341 - DNA, 480 bp, Homo sapiens
  misc_feature: HEFZJCU01CBVER.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaaggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctgtcaccgtctcctcagcctccaccaagggcccatcggtcttccccctggcaccctcctccaagagcacctctgggggcacagcggccctgggctgcctggtcaaggctacttcctagagacacg

SEQ ID NO: 453342 - DNA, 503 bp, Homo sapiens
  misc_feature: HEFZJCU01DP3LH.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgtcatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaagggcccatcggtcttcccctggcaccctcctccaagagcacctctgggggcacagcggccctgggctgcctggtcaaggactacttccgctacgtaga

SEQ ID NO: 453343 - DNA, 431 bp, Homo sapiens
  misc_feature: HEFZJCU01C4SKE.11.39.D06.1.454.heavy.3.raw
cgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaagggcccatcggtctccccctggcaccctcctccaagagcacctctgggggcacagcggccctgggctgcctggtcaaggactacttccgtatctctcg

SEQ ID NO: 453344 - DNA, 434 bp, Homo sapiens
  misc_feature: HEFZJCU01C78MP.9.30.C08.1.454.heavy.3.raw
tgatacgtctcacgaccggtgctcgatttagtctgacgtcaaagggaaagggtctgtgaagccttcacagaccctgtccctcacctgcactgtctctggtgactccatcaccggtactaattactactggagttggatccgccagcccccccgggaagggcctggagtggattggatacgccttttacagtggagtcacctactacaaccaaagggcagccccgagaaccacaggtgtacaccctgccccagaacgcaaagcagcgcctactatactttaaactttgacttctgggccagggatccctggtcaccgtctcctcagcctccaccaagggcccatcggtcttccccctggcgccctgctccaggagcacctccgagagcacagcggccctgggctgcctggtcaaggactacttccagacgtatca

SEQ ID NO: 453345 - DNA, 512 bp, Homo sapiens
  misc_feature: HEFZJCU01BEX4R.49.81.H04.1.454.heavy.3.raw
agtcgagagacacgaccggtgctcgatttagtagtgtagattcgcggggtctgggagaggaacccagcactagaagtcggcggtgtttccattcggtgatcaacactgaacacagaggactcaccatggagtttgggctgagcgtggtttcgtcgtaggctctttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaaattccaagaacacgctatatttgcacatgaacagcctgagagctgaggacacggctatttattactgtgcgaacttaatcacggaggacaaggtcgaccccgtccactcc

SEQ ID NO: 453346 - DNA, 528 bp, Homo sapiens
  misc_feature: HEFZJCU01EQTIX.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgacttttggggccaggggaaacctggtcaccggtctccccagcttccaccaagggcccatcggtcttcccccg

SEQ ID NO: 453347 - DNA, 487 bp, Homo sapiens; identical to SEQ ID NO: 445219
  misc_feature: HEFZJCU01BJ399.10.85.H08.1.454.heavy.3.raw

SEQ ID NO: 453348 - DNA, 482 bp, Homo sapiens; identical to SEQ ID NO: 444503
  misc_feature: HEFZJCU01BXEI0.7.10.A10.1.454.heavy.3.raw

SEQ ID NO: 453349 - DNA, 518 bp, Homo sapiens
  misc_feature: HEFZJCU01DSSQG.16.35.D02.1.454.heavy.3.raw
tgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaagcccggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtctggggccaagggaccg

SEQ ID NO: 453350 - DNA, 504 bp, Homo sapiens
  misc_feature: HEFZJCU01AH0ZR.19.67.G01.1.454.heavy.3.raw
tactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattatgtgtgagagtttatggcgatggctggtggacagatc

SEQ ID NO: 453351 - DNA, 513 bp, Homo sapiens
  misc_feature: HEFZJCU01EUG1M.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccggattcagcatctccagagacaacggcaagagtatactgtatctggaaatgaacaatctgagagtcgacgatacggctgtctatcattgtgttttcgatgccttcggtccgcgggacttctggggccagggtaacccg

SEQ ID NO: 453352 - DNA, 423 bp, Homo sapiens; identical to SEQ ID NO: 444772
  misc_feature: HEFZJCU01B8NXF.16.78.H01.1.454.heavy.3.raw

SEQ ID NO: 453353 - DNA, 524 bp, Homo sapiens
  misc_feature: HEFZJCU01A2PKY.5.33.C11.1.454.heavy.3.raw
atcagacacgcacgaccggtgctcgatttagagtgagctcgttgggtttgggggaggcttggtccagcctggggggtccctgagactctcctgtgtagcctccggattcacctttagtgcctattggatgacctgggtccgccaggctccagggaaggggctggagtgggtggccaatataagattcgatgtaagtgaggtgtactatgtggactctgtgaagggccgattcaccatctccagagacaacgccgagaactcactgtatctccaaatgaacagcctgagagccgaggacacggctgtctactactgtacgaatatcccctcgttttacgtatttttggactggcccgttggggtactcctacggtttggacgtctggggccaagggaccacggtcaccgtctcctcagcctccaccaagggcccatcggtcttcccctggcgccctgctccaggagcacctccgagagcacagcggccctgggctgcctggtcaaggctacttcccgtgtctgat

SEQ ID NO: 453354 - DNA, 528 bp, Homo sapiens
  misc_feature: HEFZJCU01BRLNQ.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaaccctggtcaccgtctccccaccctccc

SEQ ID NO: 453355 - DNA, 378 bp, Homo sapiens; identical to SEQ ID NO: 444419
  misc_feature: HEFZJCU01DHJ9L.47.77.G11.1.454.heavy.3.raw

SEQ ID NO: 453356 - DNA, 470 bp, Homo sapiens; identical to SEQ ID NO: 444866
  misc_feature: HEFZJCU01A0DEK.4.36.D03.1.454.heavy.3.raw

SEQ ID NO: 453357 - DNA, 482 bp, Homo sapiens
  misc_feature: HEFZJCU01E2A2M.11.23.C01.1.454.heavy.3.raw
  modified_base (480)..(480): a, c, t, g, unknown or other
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggactacttccgtatctcncg

SEQ ID NO: 453358 - DNA, 400 bp, Homo sapiens; identical to SEQ ID NO: 444452
  misc_feature: HEFZJCU01ES8QT.47.24.C02.1.454.heavy.3.raw

SEQ ID NO: 453359 - DNA, 512 bp, Homo sapiens; identical to SEQ ID NO: 445688
  misc_feature: HEFZJCU01AQNWF.3.34.D01.1.454.heavy.3.raw

SEQ ID NO: 453360 - DNA, 532 bp, Homo sapiens
  misc_feature: HEFZJCU01BBS67.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggggccggggaaccctggtcaccgtcctccccaccctccaaccg

SEQ ID NO: 453361 - DNA, 392 bp, Homo sapiens
  misc_feature: HEFZJCU01DF3FT.5.70.G04.1.454.heavy.3.raw
atcagacacgcacgaccggtgctcgatttagtgtagtgtgaagggaaagggcctggagtgggtctcaggtattacttggaatagtggtgacataggctatgcggactctgtgaagggccgcttcaccatctccagagacaacgccaagaactccctgtatctacaaatgaacagtctgagagttgaggacacggccttctattactgtgcaaaagatcgggacgaagtggtggtggctgcaatcgactactgggcctgggaaccctggtcaccgtctcctcagcctccaccaagggcccatcggtcttccccctggcaccctcctccaagagcacctctgggggcacagcggccctgggctgcctggtcaaggactacttcccgtgtctgat

SEQ ID NO: 453362 - DNA, 414 bp, Homo sapiens
  misc_feature: HEFZJCU01AQJEO.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggat

SEQ ID NO: 453363 - DNA, 490 bp, Homo sapiens; identical to SEQ ID NO: 444500
  misc_feature: HEFZJCU01BH3F1.19.53.E09.1.454.heavy.3.raw

SEQ ID NO: 453364 - DNA, 517 bp, Homo sapiens
  misc_feature: HEFZJCU01AER6M.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttcccctggcacctcctccaagagcacctctgggggcacagcggccctgggctgcctggtcaaggactacttcctagagacacg

SEQ ID NO: 453365 - DNA, 400 bp, Homo sapiens; identical to SEQ ID NO: 444452
  misc_feature: HEFZJCU01A689M.47.24.C02.1.454.heavy.3.raw

SEQ ID NO: 453366 - DNA, 527 bp, Homo sapiens
  misc_feature: HEFZJCU01BD9ED.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttgcctggttattacccttgacacttggggccagggaaccctggtcaccgtctcctcagcctccaccaagggcccatcggtcttcccctggcgccctgctccaggagcacctccgagagcacagcggccctgggctgcctggtcaaggactacttccacg

SEQ ID NO: 453367 - DNA, 518 bp, Homo sapiens; identical to SEQ ID NO: 449255
  misc_feature: HEFZJCU01BYY6K.3.17.B06.1.454.heavy.3.raw

SEQ ID NO: 453368 - DNA, 393 bp, Homo sapiens; identical to SEQ ID NO: 444509
  misc_feature: HEFZJCU01CENU9.49.46.E02.1.454.heavy.3.raw

SEQ ID NO: 453369 - DNA, 499 bp, Homo sapiens
  misc_feature: HEFZJCU01B4FC0.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcagggtcgaccatgaccagggacacgtccatcagtacagcctacatggagctgagcagtctgagacctgacgacacggccgtgtattattgtgcgttagttacggacgattacgacgttttgattggt

SEQ ID NO: 453370 - DNA, 524 bp, Homo sapiens
  misc_feature: HEFZJCU01BY5ZC.40.16.B05.1.454.heavy.3.raw
tctagcgactcacgaccggtgctcgatttagagctcacgtaagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgcccgccgggcagggactggagtggattgggcgcgtctatcacagtgaaaccagctacatcccctccctcgagagtcgagtcaccatttcactagacacgtccacaaatcagttgtccctgaggctgagctctgtgaccgccgcggacacgggcgtatattactgtgcgagaggggggccggggggaaactcctatggctcctttgactactggggccagggaaccctggtcaccgtctcctcagcctccaccaagggcccatcggtcttccccctggcgccctgctccaggagc

SEQ ID NO: 453371 - DNA, 507 bp, Homo sapiens
  misc_feature: HEFZJCU01AGCPS.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccc

SEQ ID NO: 453372 - DNA, 536 bp, Homo sapiens
  misc_feature: HEFZJCU01BQDBH.19.10.A10.1.454.heavy.3.raw
tactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaagttggggccagggaaccctggtctccgtctcgtcag

SEQ ID NO: 453373 - DNA, 520 bp, Homo sapiens
  misc_feature: HEFZJCU01CZIP9.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctggggccaggggaccctggtcatcgtctccccagcctccaccaagggcccatcggtcttcccctggcg

SEQ ID NO: 453374 - DNA, 523 bp, Homo sapiens; identical to SEQ ID NO: 445239
  misc_feature: HEFZJCU01D1BF3.9.78.H01.1.454.heavy.3.raw

SEQ ID NO: 453375 - DNA, 509 bp, Homo sapiens; identical to SEQ ID NO: 447939
  misc_feature: HEFZJCU01B8DXK.17.25.C03.1.454.heavy.3.raw

SEQ ID NO: 453376 - DNA, 508 bp, Homo sapiens
  misc_feature: HEFZJCU01C74AH.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgttttggccggtgaactactggggccagggcaccctggtcaccgtctcctcagcttccaccaagggcccatcggtcttcccctggcgccctgctccagagcacctctgggggcacagcggccctgggctgcctggtcaaggactacttccata

SEQ ID NO: 453377 - DNA, 523 bp, Homo sapiens
  misc_feature: HEFZJCU01DCD04.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagcgtgggttttccttgttaggttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaaacagcctgagaaaccgacgacacggccgtctattattgtgtcatagacctaggatacaacgacggtgtaccgtggtattc

SEQ ID NO: 453378 - DNA, 403 bp, Homo sapiens; identical to SEQ ID NO: 444540
  misc_feature: HEFZJCU01EBDKP.16.72.G06.1.454.heavy.3.raw

SEQ ID NO: 453379 - DNA, 520 bp, Homo sapiens
  misc_feature: HEFZJCU01DKZFE.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggcccggggaaccctggtcgccgtctcctcagcctccaccaagggcccatcggtcttcccctggccaccctcctccaagagcacctctgggggcacagcggccctgggctgcctggtcaaggactacttccagacgtatca

SEQ ID NO: 453380 - DNA, 478 bp, Homo sapiens
  misc_feature: HEFZJCU01C9L70.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaactttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 453381 - DNA, 507 bp, Homo sapiens
  misc_feature: HEFZJCU01C32GM.51.13.B02.1.454.heavy.3.raw
cgatcgtatacacgaccggtgctcgatttagtctagcgacttccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttgacgacacggccgtctattactgtgcgacagaagcggcggacagaggttcgcttactggttcgaggctctcccc

SEQ ID NO: 453382 - DNA, 518 bp, Homo sapiens; identical to SEQ ID NO: 444718
  misc_feature: HEFZJCU01DZT06.9.34.D01.1.454.heavy.3.raw

SEQ ID NO: 453383 - DNA, 483 bp, Homo sapiens
  misc_feature: HEFZJCU01B3YN2.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaacgggcccatcggtccttcccctggcaccctcctccaagagcacctctggggcacagcggccctgggctgcctggtcaaggactacttcctagagacacg

SEQ ID NO: 453384 - DNA, 313 bp, Homo sapiens; identical to SEQ ID NO: 444518
  misc_feature: HEFZJCU01EFT5P.7.10.A10.1.454.heavy.3.raw

SEQ ID NO: 453385 - DNA, 429 bp, Homo sapiens; identical to SEQ ID NO: 447944
  misc_feature: HEFZJCU01CEIEO.4.37.D04.1.454.heavy.3.raw

SEQ ID NO: 453386 - DNA, 396 bp, Homo sapiens; identical to SEQ ID NO: 444469
  misc_feature: HEFZJCU01C3AOW.47.46.E02.1.454.heavy.3.raw

SEQ ID NO: 453387 - DNA, 531 bp, Homo sapiens
  misc_feature: HEFZJCU01DW39L.49.25.C03.1.454.heavy.3.raw
  modified_base (508)..(508): a, c, t, g, unknown or other
agtcgagagacacgaccggtgctcgatttagtagtgtagatttgggtttgggggctctgagagaggagcccagccctgggattttcaggtgttttcatttggtgatcaggactgaacagagagaactcaccatggagtttgggctgagctggcttttcttgtggctactttaaaaggtgtccagtgtgacgtccaactggtggagtctgggggaggcttggtgcagcctggggggtccctgagactctcctgtgtagcctctgagttcacctttagagtctatgccatgagttgggtccgccaggctccaggggaaggggctggagtgggtctcaggtatcagtggtaatgatggtaacacaaactatgcagactccgtgaagggccggttcaccatcctccagagacaattccaagaatatgctatttctgcaaatgaacagcctgagaatcgaggacacggccgtatattactgtgtagaaagagatggaccgctggacgaggganccccgtagggccgggtccttacg

SEQ ID NO: 453388 - DNA, 518 bp, Homo sapiens; identical to SEQ ID NO: 445220
  misc_feature: HEFZJCU01AFG45.9.70.G04.1.454.heavy.3.raw

SEQ ID NO: 453389 - DNA, 396 bp, Homo sapiens; identical to SEQ ID NO: 444469
  misc_feature: HEFZJCU01C73YY.47.46.E02.1.454.heavy.3.raw

SEQ ID NO: 453390 - DNA, 490 bp, Homo sapiens; identical to SEQ ID NO: 444500
  misc_feature: HEFZJCU01CWF2X.19.53.E09.1.454.heavy.3.raw

SEQ ID NO: 453391 - DNA, 379 bp, Homo sapiens; identical to SEQ ID NO: 444450
  misc_feature: HEFZJCU01DAAQF.47.77.G11.1.454.heavy.3.raw

SEQ ID NO: 453392 - DNA, 511 bp, Homo sapiens
  misc_feature: HEFZJCU01BINXO.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaatgaacagcctaagtcctgaggacacgggtgtatactactgtacgaggagggggaaccagcggagtccagtactccg

SEQ ID NO: 453393 - DNA, 498 bp, Homo sapiens
  misc_feature: HEFZJCU01CXGWX.10.71.G05.1.454.heavy.3.raw
catagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctgggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaatgaccagcctgagagccgaggacacgggtgtttattactgtgggagaaatcctagtggcatctaccg

SEQ ID NO: 453394 - DNA, 518 bp, Homo sapiens; identical to SEQ ID NO: 453293
  misc_feature: HEFZJCU01EP0R3.9.34.D01.1.454.heavy.3.raw

SEQ ID NO: 453395 - DNA, 429 bp, Homo sapiens; identical to SEQ ID NO: 447944
  misc_feature: HEFZJCU01ETHXT.4.37.D04.1.454.heavy.3.raw

SEQ ID NO: 453396 - DNA, 513 bp, Homo sapiens; identical to SEQ ID NO: 447518
  misc_feature: HEFZJCU01ALSNO.19.67.G01.1.454.heavy.3.raw

SEQ ID NO: 453397 - DNA, 508 bp, Homo sapiens
  misc_feature: HEFZJCU01CNTYY.48.75.G09.1.454.heavy.3.raw
agtatacatacacgaccggtgctcgatttagtatagacatcagggggactcctgtgccccaccatggacacactttgctccacgctcctgctgctgaccatcccttcatgggtcttgtcccagatcaccttgaaggagtctggtcctacgctggtgaaacccacacagaccctcacactgacctgcaccttctcgggcttctcactcactcgtagtggggaggctgtggcctggattcgtcagcccccagggaaggccctggagtggcttgctctcatttactgggatactgatgaccgctacactccagctctgaaaaacaggctcaccatcgccatggacacctccaaaaacaggtggtccttaaaatgaccaacatggacccaatggacagcgcgacatattactgtgcacacattgattgtggtcccaccaggtgtcccgggccctttgatatctggggccgggggacattcgtcaccgtctctgcagcctccaccaagggccc

SEQ ID NO: 453398 - DNA, 482 bp, Homo sapiens; identical to SEQ ID NO: 444503
  misc_feature: HEFZJCU01DNVJE.7.10.A10.1.454.heavy.3.raw

SEQ ID NO: 453399 - DNA, 519 bp, Homo sapiens
  misc_feature: HEFZJCU01AZLXO.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggattacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaaggcccatcggtcttcccctggcaccctcctccaagagcacctctgggggcacagcggccctgggctgcctggtcaaggactacttcctagagacacg

SEQ ID NO: 453400 - DNA, 409 bp, Homo sapiens; identical to SEQ ID NO: 444519
  misc_feature: HEFZJCU01D59E6.3.41.D08.1.454.heavy.3.raw

SEQ ID NO: 453401 - DNA, 528 bp, Homo sapiens
  misc_feature: HEFZJCU01D96X3.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgacccctggggcccagggaaccctggtcaccgtctcctcagcctccaaccg

SEQ ID NO: 453402 - DNA, 526 bp, Homo sapiens
  misc_feature: HEFZJCU01CPVWS.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgtatttttggatgtctggggccaaggtacagcggtcaccgtcgcctcagcctccaccaacgggcccatcggtcttccccctggccaccctcctccaagagcacctctgggggcacgacgg

SEQ ID NO: 453403 - DNA, 507 bp, Homo sapiens
  misc_feature: HEFZJCU01DLON4.40.81.H04.1.454.heavy.3.raw
tctagcgactcacgaccggtgctcgatttagtagtgtagattcgcggggacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccaggggaaccctgggt

SEQ ID NO: 453404 - DNA, 503 bp, Homo sapiens
  misc_feature: HEFZJCU01A6P17.13.11.A11.1.454.heavy.3.raw
tcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtctgggggaggtgtggtacggcctggggggtccctcagactctcctgtgcaacctctggattcagatttgatgagtatggcatacactgggtccgccaacctccagggaaggggctgcagtgggtctctggtataaactggaatggtgccagcacaacttatgcagactctgtgaagggccgattcaccatctccagagacagtgccgagaactccgtacatctgcaaatgaacagtctcggagtcgaggacacggccttgtatttctgtgcgagggttagcagtggctgggtacttacgct

SEQ ID NO: 453405 - DNA, 396 bp, Homo sapiens; identical to SEQ ID NO: 444426
  misc_feature: HEFZJCU01ENDLV.18.31.C09.1.454.heavy.3.raw

SEQ ID NO: 453406 - DNA, 513 bp, Homo sapiens
  misc_feature: HEFZJCU01DVL5K.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaggcagattcatcatctcaagagaatgattccaacggcatcgcctatctgcagatgaacagcctgaaagaccgaggacacagccgtctattactgtgttagggtagttttacgtatttttggta

SEQ ID NO: 453407 - DNA, 511 bp, Homo sapiens
  misc_feature: HEFZJCU01DXKMB.53.43.D10.1.454.heavy.3.raw
cgcgtatacacacgaccggtgctcgatttagactagcagtaaggggtctgggagacgagcccagcactggaagtcgccggtgtttccattcggtgatcatcactgaacacagaggactcaccatggagtttgggctgagcggtcggtttcgtcgtaggcgtctttaagtaaggtgtccagtgtcaggtgcaactggtggagtctgggggaggcgtggtccagcctgggaggtccctgagactctcctgtgcagcctctggattcgccttcagtaattttgcaatgtactgggtccgccagactccaggcagggggctagactgggtggcatttgtttcatatgatggaaccattaaataactacgcagactccgtgaagggccgaatcaccatctccagagacaattccaagaacacgttgtatttgtcaatgaacaacgtgagacctgaggacacggctgtgtaattactgtgcgagagatcgtctaagggtggttcatgatgcttttga

SEQ ID NO: 453408 - DNA, 470 bp, Homo sapiens
  misc_feature: HEFZJCU01DMJ8N.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagccggcctgggctgcctggtcaaggactacttccctacagtgct

SEQ ID NO: 453409 - DNA, 515 bp, Homo sapiens
  misc_feature: HEFZJCU01C675F.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccacaaggccatcggtcttcccctggcaccctcctccaagagcacctctgggggcacagcggccctgggctgcctggtcaaggactacttccagacgtatca

SEQ ID NO: 453410 - DNA, 503 bp, Homo sapiens
  misc_feature: HEFZJCU01EOQ07.10.38.D05.1.454.heavy.3.raw
catagtagtgcacgaccggtgctcgatttagtatctgatagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctgggctg

SEQ ID NO: 453411 - DNA, 492 bp, Homo sapiens; identical to SEQ ID NO: 447948
  misc_feature: HEFZJCU01CG4VO.10.29.C07.1.454.heavy.3.raw

SEQ ID NO: 453412 - DNA, 495 bp, Homo sapiens
  misc_feature: HEFZJCU01CWOYJ.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataacagtctgagacttgaggacacggctgtctattactgtgcgagagactacggtgaccttttctggttatttcgatctctggggccgtggcaccctggtcactgtctcctcggcttccaccaacggcccatcggtcttcccctggcgcctgctccaggagcacctc

SEQ ID NO: 453413 - DNA, 514 bp, Homo sapiens
  misc_feature: HEFZJCU01BXXHJ.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccaggaagaggccggagtgggtcgcaggtatttttataggtgggacgacattctacggagactccatggagggccgattcaccatctccagagacttttctcagaacacactgtctcttcaaatgaacagcctgagggcccgaggaccacggccgtctattattgtgtgagagtttatggcgatggctggtggacagatcactggggccac

SEQ ID NO: 453414 - DNA, 477 bp, Homo sapiens
  misc_feature: HEFZJCU01DN7XN.14.70.G04.1.454.heavy.3.raw
cgtctagtaccacgaccggtgctcgatttagtgtagtgtgaagggaaagggtccctaaaactctcctgtacaacctcaggattcgcctttcgcatctatgccatggcctgggtccgccagattccagggaaggggctggagtggatctcaactattagtggaagtgggagtggtgaatccacatattacgcaggctctgtgaagggccggttcaccatctccagagacaattccaacaacacactttatctgcaaatgaacagcctgcgagccgaggacacggccctatattactgtgcaagagatcgaacaggcccgtgggagcccgttgactactggggccagggaaccctagtcatcgtctcctcagcctccaccaagggcccatcggtcttccccctggcacctcctccaagagcacctctgggggcacagcggcctgggctgcctggtcaaggactacttccgtactagacg

SEQ ID NO: 453415 - DNA, 518 bp, Homo sapiens
  misc_feature: HEFZJCU01C38PP.13.71.G05.1.454.heavy.3.raw
tcacgtactacacgaccggtgctcgatttagtgtcgtcgcaagagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggggcttggtccagcctggggggtccctgagactctcctgtgcagcctctggattcacttttagtaggtattggatgggttgggtccgccagactccagagaagggactggagtgggtggccaacataaaggaagatggaagtgaaagatactatgtggactctgtgaagggccgattcaccatctccagagacaacgccaagaactcactgtatctgcagatgaccagcctgagagtcgaggatacggctgtgtattattgtgcgagagagtggggcacggacatttttgtagaggtgtacgtgggggccagggggaccg

SEQ ID NO: 453416 - DNA, 516 bp, Homo sapiens
  misc_feature: HEFZJCU01E165R.2.33.C11.1.454.heavy.3.raw
acgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctcggggccgacgggaacccgtaccg

SEQ ID NO: 453417 - DNA, 529 bp, Homo sapiens; identical to SEQ ID NO: 446480
  misc_feature: HEFZJCU01EO1NI.18.33.C11.1.454.heavy.3.raw

SEQ ID NO: 453418 - DNA, 508 bp, Homo sapiens
  misc_feature: HEFZJCU01A3JPH.48.73.G07.1.454.heavy.3.raw
agtatacatacacgaccggtgctcgatttagctctacgctcagggcacgaccggtgctcgatttagatcgtctgtgttgggtttgggatctacgttgcaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcac

SEQ ID NO: 453419 - DNA, 518 bp, Homo sapiens
  misc_feature: HEFZJCU01AWH3M.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtcgtgggccagggaccaac

SEQ ID NO: 453420 - DNA, 383 bp, Homo sapiens; identical to SEQ ID NO: 444477
  misc_feature: HEFZJCU01B8W08.47.60.F05.1.454.heavy.3.raw

SEQ ID NO: 453421 - DNA, 537 bp, Homo sapiens
  misc_feature: HEFZJCU01D16ZL.19.10.A10.1.454.heavy.3.raw
tactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctagaagaccgaggacacagccatttactattgtacaaatgaatacgtggggaacggggggaaattggggaccagggaaccctggtctccgtctcgtca

SEQ ID NO: 453422 - DNA, 498 bp, Homo sapiens
  misc_feature: HEFZJCU01B1P1Y.12.38.D05.1.454.heavy.3.raw
atacgacgtacacgaccggtgctcgatttagtatctgatagttgggtctggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagtctggtcaccgtctcctcagcctccaccaagggcccatcggtcttcccctgcgccctgctccaggagcacctccgagagcacagcggccctgggctgcctggtcaaggactacttcctacgtcgtat

SEQ ID NO: 453423 - DNA, 528 bp, Homo sapiens
  misc_feature: HEFZJCU01B29G7.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcccggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctggggccgtggcc

SEQ ID NO: 453424 - DNA, 540 bp, Homo sapiens
  misc_feature: HEFZJCU01A4E96.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatccggtcttccccctggcaccctcctcccaagagcacctctgggggcacagcc

SEQ ID NO: 453425 - DNA, 513 bp, Homo sapiens
  misc_feature: HEFZJCU01AUD3E.48.28.C06.1.454.heavy.3.raw
agtatacatacacgaccggtgctcgatttagagctcacgtattgggtttggggggaagaggaagactgacggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggctccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactactcctatgta

SEQ ID NO: 453426 - DNA, 518 bp, Homo sapiens; identical to SEQ ID NO: 450293
  misc_feature: HEFZJCU01EXZNQ.9.70.G04.1.454.heavy.3.raw

SEQ ID NO: 453427 - DNA, 501 bp, Homo sapiens; identical to SEQ ID NO: 447719
  misc_feature: HEFZJCU01CMQ26.17.10.A10.1.454.heavy.3.raw

SEQ ID NO: 453428 - DNA, 505 bp, Homo sapiens
  misc_feature: HEFZJCU01CMVFW.10.38.D05.1.454.heavy.3.raw
  modified_base (492)..(492): a, c, t, g, unknown or other
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattcnggggccagggacg

SEQ ID NO: 453429 - DNA, 487 bp, Homo sapiens; identical to SEQ ID NO: 448944
  misc_feature: HEFZJCU01DKS3R.53.56.F01.1.454.heavy.3.raw

SEQ ID NO: 453430 - DNA, 520 bp, Homo sapiens
  misc_feature: HEFZJCU01DCCGJ.17.33.C11.1.454.heavy.3.raw
cgtagactagcacgaccggtgctcgatttagagtgagctcgttgggtttgggggactcctgtgccccaccatggacacactttgctccacgctcctgctgccgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaagggccccatcggt

SEQ ID NO: 453431 - DNA, 522 bp, Homo sapiens
  misc_feature: HEFZJCU01AIIBP.12.40.D07.1.454.heavy.3.raw
atacgacgtacacgaccggtgctcgatttagtgatagagcgtaacacagagggctcaccatggagtttgggctgagcggtggtttcgtcgttaggcgtctttaagtaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccattcaccatctccagagacaattacaagaacaccctttatctgcaaatagacagcctgagaccagacgacacggctgtctattattgcgcgcgagagacacacgaacctactggccaatactatgggggcttgttctggggccaggggaccctggtcatcgtctccccagccctccaccagggcccatcggtcttcccctggcg

SEQ ID NO: 453432 - DNA, 513 bp, Homo sapiens
  misc_feature: HEFZJCU01DO76N.52.28.C06.1.454.heavy.3.raw
cgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaagggcttgagtggatggggtggaacaatcccaacagtggaggcaccggtcgcacagaatatgcgcggaagtttcagggcagggtcaccatgaccagcgacaggtccactaacacagcctacatggagctaagtagactgacatctgacgacacggccgtctattattgtgtgagagaggacccgatgacctcgaacatggacgtctggggccg

SEQ ID NO: 453433 - DNA, 510 bp, Homo sapiens
  misc_feature: HEFZJCU01AQ0DG.12.27.C05.1.454.heavy.3.raw
atacgacgtacacgaccggtgctcgatttagacgcgatcgaagggtttggggtctgagagaggagcccagccctgggattttcaggtgttttcatttggtgatcaggactgaacagagagaactcaccatggagtttgggctgagcggtgtcgtttctaggtcggctattttaaaaggtgtccagtgtgaggtgcaactggtggagtctgggggaggcttggtacagccggggggtccctgagactctcctgtgcaggctctggattcatctttaacaactatgccatgagctgggtccgccaggctccagggaaggggctggagtgggtctcagctattagtaatagtggtgatagcacatcctacgcagactccgtgaagggccgcttcaccatctccagagacaattccaagaacacgctgtatctcaaatgaacagtctcagagccgaggacacggccatatattactgtgcgaaagacacagccgcagtttggggggatcatcgt

SEQ ID NO: 453434 - DNA, 522 bp, Homo sapiens
  misc_feature: HEFZJCU01ES3L8.40.44.D11.1.454.heavy.3.raw
tctagcgactcacgaccggtgctcgatttagcgcagtacgaagggggctttctgagagtcatggacctcctgcacaagaacatgaaacacctgtggttcttcctcctcctggtggcagctcccagatgggtcctgtcccaggtgcagctacagcagtggggcacaagactgttgaagccttcggagaccctgtccttcacctgcgctgtctatggtgggtccttcagtggttactactggacctggatccgccagcccccagggaaggggctggagtggattggggaaatcaatcatagtggaagcaccaactacaacccgtcactcaagagtcgactcaccatatcagtagacacgtccaagaaccagttctccctgaagctgagctctgtgaccgccgcggacacggctgtgtattactgtgcgagaggcttggtagcagtggctcccgggggcttttgacttactggggccagggaacccctggtcaccgtctcctcagcctccaccaagggcccatcc

SEQ ID NO: 453435 - DNA, 502 bp, Homo sapiens
  misc_feature: HEFZJCU01C87V7.11.19.B08.1.454.heavy.3.raw
cgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccgccaggctccagggaaggggctgggagtgggtttcatacatttctagtaattctggtaccatacactatgcagtctctgtgaagggccgattcaccatctccagagacaacgccaggaactcactttatctgcaaatgagcagcctgagagtcgaggacacgggtatttattactgtgcgagagatagtctgtctatgcttccgggagctaa

SEQ ID NO: 453436 - DNA, 469 bp, Homo sapiens
  misc_feature: HEFZJCU01BL4SQ.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcggccctgggctgcctggtcaggactacttccctacagtgct

SEQ ID NO: 453437 - DNA, 534 bp, Homo sapiens
  misc_feature: HEFZJCU01CUNNB.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagtttatgggtttggggggagttggggtttttttttcgtacgttacggg

SEQ ID NO: 453438 - DNA, 431 bp, Homo sapiens
  misc_feature: HEFZJCU01DGAGW.11.39.D06.1.454.heavy.3.raw
cgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaagggcccatcggtcttccccctggcaccctcctccaagagcacctctgggggcacagcggcctgggctgcctggtcaaggactacttccgtatctctcg

SEQ ID NO: 453439 - DNA, 515 bp, Homo sapiens
  misc_feature: HEFZJCU01C2JVJ.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtctggggcctagggactacggtcaccgtctcctcagcctccaccaagggcccatcggtcttcccctggccta

SEQ ID NO: 453440 - DNA, 505 bp, Homo sapiens
  misc_feature: HEFZJCU01CJ131.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactgggccagggcaccctggtcaccgtctcctcagcttccaccaagggcccatcggtcttcccctggcgccctgctccaggagcacctctggggcacagcggccctgggctgcctggtcaggactactccata

SEQ ID NO: 453441 - DNA, 509 bp, Homo sapiens
  misc_feature: HEFZJCU01EGR3Q.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggcttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggcccacatattactgtgcgaaagatcgtcgggctggttccgcggtccgggt

SEQ ID NO: 453442 - DNA, 514 bp, Homo sapiens; identical to SEQ ID NO: 451149
  misc_feature: HEFZJCU01ESKIB.7.71.G05.1.454.heavy.3.raw

SEQ ID NO: 453443 - DNA, 445 bp, Homo sapiens
  misc_feature: HEFZJCU01BQQAG.48.42.D09.1.454.heavy.3.raw
agtatacatacacgaccggtgctcgatttagacacatacgcagggaaaggggactagaaggggaactggtcttaattgcttgatgaagagcaggagactcatttatgtgagtcttttgagtgaccattgtctgggtcactcccatttaactttccctaaagcccatttgaaggagaggtcgcacgagctgctccacaacctctgaatggggatggcatgggtaatgatgcttgagaacataccaagcccccactggcatcgcccttgtctaagtcattgactgtaggtcatcatcgcacccttgaaagtagcccatgccttccaaagcgatttatgcctccaccaagggcccatcggtcttccccctggcaccctcctccaagagcacctctgggggcacagcggccctgggctgcctggtcaaggactacttcctatgtatact

SEQ ID NO: 453444 - DNA, 387 bp, Homo sapiens; identical to SEQ ID NO: 449679
  misc_feature: HEFZJCU01EK2XQ.19.86.H09.1.454.heavy.3.raw

SEQ ID NO: 453445 - DNA, 490 bp, Homo sapiens
  misc_feature: HEFZJCU01DWITK.51.38.D05.1.454.heavy.3.raw
cgatcgtatacacgaccggtgctcgatttagtatctgatagttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggtcttcttttactgtcgcgcgaggaacg

SEQ ID NO: 453446 - DNA, 499 bp, Homo sapiens; identical to SEQ ID NO: 453198
  misc_feature: HEFZJCU01AELGQ.11.71.G05.1.454.heavy.3.raw

SEQ ID NO: 453447 - DNA, 511 bp, Homo sapiens
  misc_feature: HEFZJCU01CN075.13.23.C01.1.454.heavy.3.raw
tcacgtactacacgaccggtgctcgatttagtacacgtgattagggattgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaattctatgcagactccgtgaagggccgattcaccgtctccagggacaactccaagaaccaccttatatctgcagatgaacagcctgagaggtgacgactcggctgtatacttctgtgcgacaaacatgatgtttggagtggatgtgtacttctaccactacggaatggacgtctggggccaagggaccgcggtcaccgtctcctcagcctccaccaagggcccatcggtcttccccctggcaccctcctccaagagcacctctgggggcacagcggccctgggctgcctggtcaaggactacttcctagta

SEQ ID NO: 453448 - DNA, 432 bp, Homo sapiens; identical to SEQ ID NO: 444920
  misc_feature: HEFZJCU01B88K6.11.39.D06.1.454.heavy.3.raw

SEQ ID NO: 453449 - DNA, 482 bp, Homo sapiens
  misc_feature: HEFZJCU01DUTB9.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcctcccctggcaccctcctccaagagcacctctgggggcacagcggccctgggctgcctggtcaaggactacttcctagagacacg

SEQ ID NO: 453450 - DNA, 523 bp, Homo sapiens
  misc_feature: HEFZJCU01CUKWE.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatgggacgtcgtcgggggccaaggggaccg

SEQ ID NO: 453451 - DNA, 517 bp, Homo sapiens
  misc_feature: HEFZJCU01B1EXZ.16.2.A02.1.454.heavy.3.raw
tgtactactccacgaccggtgctcgatttagactcatctacagggggagagaggagccttagccctggattccaaggcctatccacttggtgatcagcactgaccaccgaggattcaccatggagctggggctccgctgggttttccttgttgctattttagaaggtgtccagagtgaggtgcagctggtggagtttgggggaggcctggtcaagcctggggggtccctgagactctcctgtgcagcctctgaattcatcttcagtatctataacatgaactgggtccgccagactccagggaaggggctggagtgggtcgcatccattagtggtggtaataattacatatactacggagactcaatgaagggccgcttcaccatctccagagacaacgccgaaaactcactgtatctgcagatgaacagcctgagagccgaagacacggctgtgtattactgtgcgagaggtcttactataggttcggggagttaatataacgacgtatttacgta

SEQ ID NO: 453452 - DNA, 410 bp, Homo sapiens; identical to SEQ ID NO: 447169
  misc_feature: HEFZJCU01AGP18.51.31.C09.1.454.heavy.3.raw

SEQ ID NO: 453453 - DNA, 493 bp, Homo sapiens
  misc_feature: HEFZJCU01CMRNT.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggccgccctgctccaggagcacctccgagagcacagccggcccgtgggctgcctggtcaggactacttccgtatctctcg

SEQ ID NO: 453454 - DNA, 370 bp, Homo sapiens; identical to SEQ ID NO: 446460
  misc_feature: HEFZJCU01AJ53Q.14.77.G11.1.454.heavy.3.raw

SEQ ID NO: 453455 - DNA, 505 bp, Homo sapiens
  misc_feature: HEFZJCU01BA53D.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccacc

SEQ ID NO: 453456 - DNA, 519 bp, Homo sapiens
  misc_feature: HEFZJCU01DPADV.49.59.F04.1.454.heavy.3.raw
agtcgagagacacgaccggtgctcgatttagtacacacacttagggattggggcagctacaggtgtccagtcccaggtccagctggtgcaatctggggctgaggtgaagaagcctgggtcctcggtgaaggtctcctgtaaggcttctggaggcaccctcagcagttatactatgaattggggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactggggccagggaacctggtcaccgtctcctcagcctccaccaaggcccatcggtcttcccctggcaccctcctccaagagcacctctggggcacagcggccctggctgcctggtcaac

SEQ ID NO: 453457 - DNA, 500 bp, Homo sapiens
  misc_feature: HEFZJCU01CQIYH.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtctggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtggtattactgtgcgagactggccgcaacagactacggtggcaactcctatgcttttgatatctgggccagggact

SEQ ID NO: 453458 - DNA, 529 bp, Homo sapiens
  misc_feature: HEFZJCU01CLFBT.18.33.C11.1.454.heavy.3.raw
  modified_base (411)..(411): a, c, t, g, unknown or other
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtntccccaccctccaccaagggcccatcggtcttccccctggccaccctcctcccaagagcacctctgggggcacagcggccctgggctgcctggtcaaggactacttcccatactcgta

SEQ ID NO: 453459 - DNA, 491 bp, Homo sapiens; identical to SEQ ID NO: 444592
  misc_feature: HEFZJCU01DY7ZQ.11.26.C04.1.454.heavy.3.raw

SEQ ID NO: 453460 - DNA, 520 bp, Homo sapiens; identical to SEQ ID NO: 453029
  misc_feature: HEFZJCU01CTJFD.16.86.H09.1.454.heavy.3.raw

SEQ ID NO: 453461 - DNA, 483 bp, Homo sapiens; identical to SEQ ID NO: 444639
  misc_feature: HEFZJCU01DN6JD.11.23.C01.1.454.heavy.3.raw

SEQ ID NO: 453462 - DNA, 494 bp, Homo sapiens
  misc_feature: HEFZJCU01ATMJZ.13.67.G01.1.454.heavy.3.raw
tcacgtactacacgaccggtgctcgatttagagtatacatattgggtctggggggggcttggtccagcctggggggtccctgagactctcctgtgcagcctctggattcacttttagtaggtattggatgggttgggtccgccagactccagagaagggactggagtgggtggccaacataaaggaagatggaagtgaaagatactatgtggactctgtgaagggccgattcaccatctccagagacaacgccaagaactcactgtatctgcagatgaccagcctgagagtcgaggatacggctgtgtattattgtgcgagagatggggcacgacattttgtagaggtgtactggggccagggagccccggtcaccgtctcctcagcctccaccaagggcccatcggtcttcccctggcgccctgctccaggagcacctccgagagcacagcggccctgggctgcctggtcaaggactacttcctagtacgtga

SEQ ID NO: 453463 - DNA, 482 bp, Homo sapiens; identical to SEQ ID NO: 444503
  misc_feature: HEFZJCU01BN3AY.7.10.A10.1.454.heavy.3.raw

SEQ ID NO: 453464 - DNA, 496 bp, Homo sapiens; identical to SEQ ID NO: 444697
  misc_feature: HEFZJCU01DV6VB.16.37.D04.1.454.heavy.3.raw

SEQ ID NO: 453465 - DNA, 510 bp, Homo sapiens; identical to SEQ ID NO: 448445
  misc_feature: HEFZJCU01DEEDN.16.71.G05.1.454.heavy.3.raw

SEQ ID NO: 453466 - DNA, 484 bp, Homo sapiens; identical to SEQ ID NO: 446564
  misc_feature: HEFZJCU01DBVES.19.13.B02.1.454.heavy.3.raw

SEQ ID NO: 453467 - DNA, 480 bp, Homo sapiens; identical to SEQ ID NO: 445011
  misc_feature: HEFZJCU01A7HLS.22.36.D03.1.454.heavy.3.raw

SEQ ID NO: 453468 - DNA, 546 bp, Homo sapiens
  misc_feature: HEFZJCU01AWEUG.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacggggcgtttattactgtgcgagagggacggactacgggtgacctacgtgggggtttccgaccccgtcgggggcccacggggaacccctgggtccaccgtctccctcacgccctccaacccg

SEQ ID NO: 453469 - DNA, 519 bp, Homo sapiens
  misc_feature: HEFZJCU01EA2A7.12.40.D07.1.454.heavy.3.raw
atacgacgtacacgaccggtgctcgatttagtgatagagcgtaacacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctcaccaagggcccatcggtctcccctggccg

SEQ ID NO: 453470 - DNA, 504 bp, Homo sapiens
  misc_feature: HEFZJCU01EQX14.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaagacacggctgtgtattactgttcgagacgggctagtctgggatctagttatagtgactcgtcgtttctggggaccg

SEQ ID NO: 453471 - DNA, 503 bp, Homo sapiens; identical to SEQ ID NO: 445995
  misc_feature: HEFZJCU01AZE0E.17.25.C03.1.454.heavy.3.raw

SEQ ID NO: 453472 - DNA, 526 bp, Homo sapiens
  misc_feature: HEFZJCU01C4CH1.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaagggcccatcggtcttcccctggcaccctcctccaagagcacctctgggggcacagcggccctgggctgcctggtcaaggactacttcccatactcgta

SEQ ID NO: 453473 - DNA, 516 bp, Homo sapiens
  misc_feature: HEFZJCU01D7OCP.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctggggaggtcacagagactctcctgtgcagcctctgggttcaccttcagtagctacggcatgcactgggtccgccaaactccaggcaagggattggagtgggtgcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaacgagcgggagttccaagtactcctttg

SEQ ID NO: 453474 - DNA, 499 bp, Homo sapiens
  misc_feature: HEFZJCU01EDJK3.40.81.H04.1.454.heavy.3.raw
tctagcgactcacgaccggtgctcgatttagtagtgtagattcgcgggggcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctgggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctggaccactggggccac

SEQ ID NO: 453475 - DNA, 527 bp, Homo sapiens
  misc_feature: HEFZJCU01EA38U.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaaggcccatcggtcttcccctggcaccctcctccaagagcacctctgggggcacagcggccctgggctg

SEQ ID NO: 453476 - DNA, 509 bp, Homo sapiens; identical to SEQ ID NO: 444586
  misc_feature: HEFZJCU01C0GTK.12.78.H01.1.454.heavy.3.raw

SEQ ID NO: 453477 - DNA, 489 bp, Homo sapiens; identical to SEQ ID NO: 447707
  misc_feature: HEFZJCU01A6X6F.10.55.E11.1.454.heavy.3.raw

SEQ ID NO: 453478 - DNA, 490 bp, Homo sapiens; identical to SEQ ID NO: 446494
  misc_feature: HEFZJCU01ESJL3.11.13.B02.1.454.heavy.3.raw

SEQ ID NO: 453479 - DNA, 483 bp, Homo sapiens; identical to SEQ ID NO: 444924
  misc_feature: HEFZJCU01DUN87.10.35.D02.1.454.heavy.3.raw

SEQ ID NO: 453480 - DNA, 504 bp, Homo sapiens; identical to SEQ ID NO: 445222
  misc_feature: HEFZJCU01CWT2M.9.33.C11.1.454.heavy.3.raw

SEQ ID NO: 453481 - DNA, 380 bp, Homo sapiens
  misc_feature: HEFZJCU01D0TGD.13.58.F03.1.454.heavy.3.raw
tcacgtactacacgaccggtgctcgatttagtctgatcgagaagggaaggggctggagtgggtttcatatatcactggtgatagtgcttccacatattacgcagactctatgaagggccgattcaccatctccagagacaatgccaggaactcgctgtatctgcaaatgaacagcctgagagccgaggacacggctgtctattactgtgcgaaagccagggggcggtttattgactactggggccagggaatcctggtcaccgtctcctcagcctccaccaagggcccatcggtcttccccctggcaccctcctccaagagcacctctggggcacagcggccctgggctgcctggtcaaggactacttcctagtacgtga

SEQ ID NO: 453482 - DNA, 400 bp, Homo sapiens; identical to SEQ ID NO: 444452
  misc_feature: HEFZJCU01DED95.47.24.C02.1.454.heavy.3.raw

SEQ ID NO: 453483 - DNA, 394 bp, Homo sapiens
  misc_feature: HEFZJCU01EZ1SO.10.42.D09.1.454.heavy.3.raw
catagtagtgcacgaccggtgctcgatttagacacatacgcagggaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaagggctggttacatgtttgactcctggggccagggaatcctggtcaccgtctcctcagcctccaccaagggcccatcggtcttccccctggcgccctgctccaggagcacctccgagagcacagcggccctgggctgcctggtcaaggactacttcccactactatg

SEQ ID NO: 453484 - DNA, 491 bp, Homo sapiens
  misc_feature: HEFZJCU01A4YVN.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctaggagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcagagagttgacgagt

SEQ ID NO: 453485 - DNA, 499 bp, Homo sapiens; identical to SEQ ID NO: 451991
  misc_feature: HEFZJCU01BCXPV.13.12.B01.1.454.heavy.3.raw

SEQ ID NO: 453486 - DNA, 491 bp, Homo sapiens; identical to SEQ ID NO: 446104
  misc_feature: HEFZJCU01EKEUZ.3.34.D01.1.454.heavy.3.raw

SEQ ID NO: 453487 - DNA, 489 bp, Homo sapiens
  misc_feature: HEFZJCU01EBL39.51.14.B03.1.454.heavy.3.raw
cgatcgtatacacgaccggtgctcgatttagtgtgagtagtttgggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttccccctggccaccctcctccaagagcacctctgggggcacagcggccctgggctgcctggtcaaggactacttcctcgtacgcact

SEQ ID NO: 453488 - DNA, 494 bp, Homo sapiens
  misc_feature: HEFZJCU01DADC7.49.87.H10.1.454.heavy.3.raw
  modified_base (485)..(485): a, c, t, g, unknown or other
agtcgagagacacgaccggtgctcgatttagcagtactgcgttgggtttggggtctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctggggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttacaaatgaacactctgagacgtgaggacacggctgtctattactgtgcgactganatgtcttta

SEQ ID NO: 453489 - DNA, 400 bp, Homo sapiens; identical to SEQ ID NO: 444452
  misc_feature: HEFZJCU01BZU4F.47.24.C02.1.454.heavy.3.raw

SEQ ID NO: 453490 - DNA, 545 bp, Homo sapiens
  misc_feature: HEFZJCU01CF27F.15.86.H09.1.454.heavy.3.raw
tctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaagtaaaatgatggtgagaaaatagactacggtgcacccgtgaaaggaagattcaccatctcaagagataattcaaaaacgacggtgtatttgcaaatgaacagcctgaaaaccgaggacacagccgtctattactgtaccacagattcggaagtgcatcgacgtaaaggaggctatgcttttgatatctggggcccaggggacaatc

SEQ ID NO: 453491 - DNA, 520 bp, Homo sapiens; identical to SEQ ID NO: 453029
  misc_feature: HEFZJCU01CBNBO.16.86.H09.1.454.heavy.3.raw

SEQ ID NO: 453492 - DNA, 491 bp, Homo sapiens
  misc_feature: HEFZJCU01EV4Y5.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgtccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttccccctggcgccctgctccaggagcacctccgagagcacagcggccctgggctgcctggtcaaggactacttcccatactcgta

SEQ ID NO: 453493 - DNA, 506 bp, Homo sapiens
  misc_feature: HEFZJCU01EZAU0.13.23.C01.1.454.heavy.3.raw
tcacgtactacacgaccggtgctcgatttagtacacgtgattagggattgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaaattctatgcagactccgtgaagggccgattcaccgtctccagggacaactccaagaacaccttatatctgcagatgaacagcctgagaggtgacgactcggctgtatacttctgtgcgacaaacatgatgtttggagtggatgtgtacttctaccactacggaatggacgtctggggccaagggaccgcggtcaccgtctcctcagcctccaccaagggcccatcggtcttccccctggccaccctcctccaagagcacctctggggcacagcggcctgggctgcctgtcaggactacttccgta

SEQ ID NO: 453494 - DNA, 520 bp, Homo sapiens
  misc_feature: HEFZJCU01CNGNN.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggc

SEQ ID NO: 453495 - DNA, 515 bp, Homo sapiens
  misc_feature: HEFZJCU01CFE23.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccaccaagctccaggcaagggattggagtgggtggcagttgtttcatctgagggcagtgttcaatggtatgcagactccgtgaagggtcgattcaccatctccagagacaattccaggaacacaatgtatttggaaatgaacagcctaagtcctgaggacacgggtgtatactactgtacgaaggagggggaacgagcgggaggtcctaagtactcctttcgt

SEQ ID NO: 453496 - DNA, 482 bp, Homo sapiens; identical to SEQ ID NO: 444503
  misc_feature: HEFZJCU01CGFUP.7.10.A10.1.454.heavy.3.raw

SEQ ID NO: 453497 - DNA, 507 bp, Homo sapiens
  misc_feature: HEFZJCU01BU6E0.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggagtgttcaatactatacagactccgtgaagggccgattcaccatctccagagacaattccaagaacacgatgtatctgcaaatggacagcctaagagttgaggacacggctgtttattactgtacgaaagaggggggatacgagtggcagctccaagtacttac

SEQ ID NO: 453498 - DNA, 524 bp, Homo sapiens
  misc_feature: HEFZJCU01BVZMB.4.33.C11.1.454.heavy.3.raw
agcactgtagcacgaccggtgctcgatttagagtgagctcgttgggtttgggcttagctgggttttccttgttgctattttaaaaggtgtccaatgtgaggtgcagctggtggagtctggggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggagttttacgatttttggagtggatattataaccccacctttgactactggggccagggaaccctggtcgccgtctcctcagcctccaccaaggcccatcggtcttcccctggccgccctgctcca

SEQ ID NO: 453499 - DNA, 487 bp, Homo sapiens
  misc_feature: HEFZJCU01EET1P.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggagcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattattgtgtcccttgattacta

SEQ ID NO: 453500 - DNA, 315 bp, Homo sapiens; identical to SEQ ID NO: 444763
  misc_feature: HEFZJCU01D7M0U.47.56.F01.1.454.heavy.3.raw

SEQ ID NO: 453501 - DNA, 535 bp, Homo sapiens
  misc_feature: HEFZJCU01ALPBM.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgtccgtttattttgtacgagagcgtcgtctgtcagtggaattgactacgtggggccagggaaccctggtccaccgtctcctcagcctccaccaacggg

SEQ ID NO: 453502 - DNA, 505 bp, Homo sapiens
  misc_feature: HEFZJCU01EMMBY.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtccttcccctggccgccctgctccaggagcacctccgagagcacacgccggcccgtgggctcgcctggtcaaggacttaccg

SEQ ID NO: 453503 - DNA, 487 bp, Homo sapiens; identical to SEQ ID NO: 445219
  misc_feature: HEFZJCU01C9U27.10.85.H08.1.454.heavy.3.raw

SEQ ID NO: 453504 - DNA, 487 bp, Homo sapiens; identical to SEQ ID NO: 445219
  misc_feature: HEFZJCU01CRDKH.10.85.H08.1.454.heavy.3.raw

SEQ ID NO: 453505 - DNA, 514 bp, Homo sapiens
  misc_feature: HEFZJCU01C6DF9.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcaagaaaaactatgtggactctgtgaacggccgattcaccatctccagagacaacgccaagaattcactgtatttgcaaatgaacagcctgagaggcgaggacacggccgtgtattattgtgcgcgagatgatagtagactctacagtagcgaggtggta

SEQ ID NO: 453506 - DNA, 494 bp, Homo sapiens
  misc_feature: HEFZJCU01B4EOI.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcggccctgggctgcctggtcaaggactacttccctacagtgct

SEQ ID NO: 453507 - DNA, 513 bp, Homo sapiens; identical to SEQ ID NO: 446452
  misc_feature: HEFZJCU01BSQSV.17.33.C11.1.454.heavy.3.raw

SEQ ID NO: 453508 - DNA, 498 bp, Homo sapiens
  misc_feature: HEFZJCU01DZ9L7.51.3.A03.1.454.heavy.3.raw
cgatcgtatacacgaccggtgctcgatttagagagcgtcacaggggacccaacaaccacatccctcctcagaagccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaagctttgagtggatgggatggatcaccgctggcaatggtgacacaaaatattcacagaagttccagggcagagtcaccattaacagggacacatctgcgagtacaggctacatggaactgagcggcctgagatctgaggacacggctatttattactgtgcgagagggaagtgggatattgtggcagctccaggtgcccagcccggcccccttacg

SEQ ID NO: 453509 - DNA, 501 bp, Homo sapiens; identical to SEQ ID NO: 447123
  misc_feature: HEFZJCU01CRBWJ.3.20.B09.1.454.heavy.3.raw

SEQ ID NO: 453510 - DNA, 536 bp, Homo sapiens
  misc_feature: HEFZJCU01BHBNC.19.10.A10.1.454.heavy.3.raw
tactctcgtgcacgaccggtgctcgatttagcgtcgatctcaggggagctctgggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctgggttcgccaggctccagggaagggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccattttactattgtacaaatgaatactggggacggggggaaaattggggaccagggaaccctggtctccgtcc

SEQ ID NO: 453511 - DNA, 490 bp, Homo sapiens
  misc_feature: HEFZJCU01BYAQ3.4.57.F02.1.454.heavy.3.raw
agcactgtagcacgaccggtgctcgatttagctcgatatagttgggtttgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctgggggcacagcggccctgggctgcctggtcaaggactacttccctaagtgct

SEQ ID NO: 453512 - DNA, 502 bp, Homo sapiens; identical to SEQ ID NO: 445414
  misc_feature: HEFZJCU01DAEEX.17.25.C03.1.454.heavy.3.raw

SEQ ID NO: 453513 - DNA, 515 bp, Homo sapiens; identical to SEQ ID NO: 446186
  misc_feature: HEFZJCU01BU0CP.9.70.G04.1.454.heavy.3.raw

SEQ ID NO: 453514 - DNA, 509 bp, Homo sapiens; identical to SEQ ID NO: 444586
  misc_feature: HEFZJCU01EZZT1.12.78.H01.1.454.heavy.3.raw

SEQ ID NO: 453515 - DNA, 520 bp, Homo sapiens; identical to SEQ ID NO: 447654
  misc_feature: HEFZJCU01EUKF6.10.79.H02.1.454.heavy.3.raw

SEQ ID NO: 453516 - DNA, 510 bp, Homo sapiens; identical to SEQ ID NO: 449039
  misc_feature: HEFZJCU01CLNGQ.7.28.C06.1.454.heavy.3.raw

SEQ ID NO: 453517 - DNA, 505 bp, Homo sapiens
  misc_feature: HEFZJCU01EGF9C.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggccatcggtcttcccctggcaccctcctccaagagcacctctgggggcacagcggccctgggctgcctggtcaaggactacttccgagtagtaca

SEQ ID NO: 453518 - DNA, 491 bp, Homo sapiens; identical to SEQ ID NO: 446104
  misc_feature: HEFZJCU01AC6QY.3.34.D01.1.454.heavy.3.raw

SEQ ID NO: 453519 - DNA, 530 bp, Homo sapiens
  misc_feature: HEFZJCU01CGY9J.17.34.D01.1.454.heavy.3.raw
cgtagactagcacgaccggtgctcgatttagatcgtctgtgttgggtttggggacaaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctcccttgacttctggggccatggaacccggtcaccgt

SEQ ID NO: 453520 - DNA, 538 bp, Homo sapiens
  misc_feature: HEFZJCU01BFVD2.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttcccctggcaccctcctccaagagcacctctggggggcacagcc

SEQ ID NO: 453521 - DNA, 525 bp, Homo sapiens
  misc_feature: HEFZJCU01DV4YJ.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaaggcccatcggtcttcccctggcaccctcctccagagcacctctgggggcacagcggccctggctg

SEQ ID NO: 453522 - DNA, 497 bp, Homo sapiens
  misc_feature: HEFZJCU01D697Y.3.35.D02.1.454.heavy.3.raw
agacgcactccacgaccggtgctcgatttagcacacgatagttgggtttgggggaggcttggtgcagcctggggggtctctgagactctcctgtgcagcctctggagtgacctttagcaaatatggcatggcctgggtccgtcaggttccagggaaggggctggagtgggtctcggctattagtggccgtggtgaaagcatcttctacgcagactccgtgaagggccgattcaccatctccagagacaattccagggacacgctgtatctgcagatggacagcctgagagtcgaggacacggccttatattactgtgcgaaagccgtagtggcaacaacgttgtgctttgactcctggggccagggaaccctggtcgccgtctcctcagcctccaccaagggcccatcggtcttcccctggcaccctcctccaagagcacctctgggggcacagcggccctgggctgcctggtcaaggactacttccgagtgcgtct

SEQ ID NO: 453523 - DNA, 509 bp, Homo sapiens
  misc_feature: HEFZJCU01D7WO0.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggtcttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaagggcccatcc

SEQ ID NO: 453524 - DNA, 536 bp, Homo sapiens
  misc_feature: HEFZJCU01CFNW0.48.27.C05.1.454.heavy.3.raw
agtatacatacacgaccggtgctcgatttagacgcgatcgaagggtttggggggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctgggccaagggacctcggtcgccgtttcctcagcctccaccaaggccc

SEQ ID NO: 453525 - DNA, 449 bp, Homo sapiens
  misc_feature: HEFZJCU01DW6QU.16.53.E09.1.454.heavy.3.raw
tgtactactccacgaccggtgctcgatttagagagagtgtgttgggtttaggattcacgttgcagatgtaggtctgggtgcgccagatgcccgggaaaggcctggagtggatggggaggattgaggctagtgactcttataccaactacagcccgtccttccaaggccacgtcaccatctcagttgacaagtccatcaacactgcccacctgcagtggagcagcctgaaggcctcggacaccgccatgtattactgtgcgagacatggggatttatattgtactaataatgtatgccactttgactactggggccagggaaccctggtcaccgtctcctcagcctccaccaagggcccatcggtcttcccctggcaccctcctccaagagcacctctgggggcacagcgccctgggctgcctggtcaaggactacttccgagtagtaca

SEQ ID NO: 453526 - DNA, 527 bp, Homo sapiens
  misc_feature: HEFZJCU01D81OZ.12.39.D06.1.454.heavy.3.raw
  modified_base (377)..(377): a, c, t, g, unknown or other
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagaggggganagtggagtagaacgtaaatacgggaaaccgtttgacttttggggccagggaacctggtcaccgtctcctcagcctccaccaaggcccatcggtcttcccctggcaccctcctccaagagcacctctggggcacagcggcctggctgcctc

SEQ ID NO: 453527 - DNA, 502 bp, Homo sapiens; identical to SEQ ID NO: 445563
  misc_feature: HEFZJCU01AY95V.10.38.D05.1.454.heavy.3.raw

SEQ ID NO: 453528 - DNA, 498 bp, Homo sapiens
  misc_feature: HEFZJCU01BAG0D.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcgggctgaccactgggccg

SEQ ID NO: 453529 - DNA, 526 bp, Homo sapiens
  misc_feature: HEFZJCU01CH9MG.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaacctggtcacgtctccccaccctccaccg

SEQ ID NO: 453530 - DNA, 510 bp, Homo sapiens; identical to SEQ ID NO: 445542
  misc_feature: HEFZJCU01ENG4G.16.21.B10.1.454.heavy.3.raw

SEQ ID NO: 453531 - DNA, 507 bp, Homo sapiens
  misc_feature: HEFZJCU01ESF48.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggagggggaacagcggagttcagtactcttgacgtctgggcc

SEQ ID NO: 453532 - DNA, 400 bp, Homo sapiens; identical to SEQ ID NO: 445493
  misc_feature: HEFZJCU01AIGBL.13.4.A04.1.454.heavy.3.raw

SEQ ID NO: 453533 - DNA, 482 bp, Homo sapiens
  misc_feature: HEFZJCU01CVBKG.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggactacttccgtatctctcg

SEQ ID NO: 453534 - DNA, 499 bp, Homo sapiens; identical to SEQ ID NO: 447792
  misc_feature: HEFZJCU01ED5V2.17.10.A10.1.454.heavy.3.raw

SEQ ID NO: 453535 - DNA, 517 bp, Homo sapiens
  misc_feature: HEFZJCU01CZQRY.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 453536 - DNA, 542 bp, Homo sapiens
  misc_feature: HEFZJCU01EKJ25.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggctggatcggggagtttggttcctggggccaggggaaccctggtccg

SEQ ID NO: 453537 - DNA, 512 bp, Homo sapiens
  misc_feature: HEFZJCU01CVFXN.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagccaagacagattttggagtggttactgttggactactttgactactggggccaggggaaccctgggt

SEQ ID NO: 453538 - DNA, 530 bp, Homo sapiens
  misc_feature: HEFZJCU01BK9J5.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttatactgtgcgagagggacggactacggtgactacgtgggggttcgaccccgtgggggccaggggaaccctggtcaccgtctcctcagccctccaccg

SEQ ID NO: 453539 - DNA, 498 bp, Homo sapiens
  misc_feature: HEFZJCU01C9DYV.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtcgtggggtggctacgagtactggtacttcgatctctgggccgtggcaccctgctgactgtctcctcagcctccaccaagggcccatcggtcttcccctggcgccctgctccaggagcacctccgagagcacagcggccctgggctgcctggtcaaggactaccg

SEQ ID NO: 453540 - DNA, 525 bp, Homo sapiens
  misc_feature: HEFZJCU01A7XQJ.9.30.C08.1.454.heavy.3.raw
tgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccaggggatccctggtcaccgtctcctcagcct

SEQ ID NO: 453541 - DNA, 381 bp, Homo sapiens
  misc_feature: HEFZJCU01DBH5E.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggaaccctgggctgcctggtcaaggactacttcctacgtgagct

SEQ ID NO: 453542 - DNA, 512 bp, Homo sapiens; identical to SEQ ID NO: 450914
  misc_feature: HEFZJCU01EBAKL.15.67.G01.1.454.heavy.3.raw

SEQ ID NO: 453543 - DNA, 521 bp, Homo sapiens; identical to SEQ ID NO: 445317
  misc_feature: HEFZJCU01D2TKQ.12.40.D07.1.454.heavy.3.raw

SEQ ID NO: 453544 - DNA, 498 bp, Homo sapiens; identical to SEQ ID NO: 445952
  misc_feature: HEFZJCU01EFZ9Q.11.71.G05.1.454.heavy.3.raw

SEQ ID NO: 453545 - DNA, 500 bp, Homo sapiens
  misc_feature: HEFZJCU01EWRKR.3.55.E11.1.454.heavy.3.raw
agacgcactccacgaccggtgctcgatttagcactcgcacgttgggtttgggattcacgttgcagatgtaggtccctgagactctcctgtgcagcctctggattcaccttcagtagatatgctatgtattgggtccgtcaggctccaggcaaggggctggagtgggtggcagttatgtcacatgatggaagaaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccagggaaccctggtcaccgtctcctcagcctccaccaagggcccatcggtcttcccctggcgccctgctccaggagcacctccgagagcacagcggccctgggctgcctggtcaaggactacttccga

SEQ ID NO: 453546 - DNA, 501 bp, Homo sapiens; identical to SEQ ID NO: 447719
  misc_feature: HEFZJCU01CC7ZS.17.10.A10.1.454.heavy.3.raw

SEQ ID NO: 453547 - DNA, 505 bp, Homo sapiens
  misc_feature: HEFZJCU01EUZXT.4.81.H04.1.454.heavy.3.raw
agcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctggggggtccctgagactctcgtgtgtagtctctgaattcatcttcagggactttgacatgaattgggtccgccaggctccagggaaggggctggagtgggtctcatccatcagttccagtactcgttacatatactacgcagactcagtgaggggccgattcaccatctccagagacaacgccaagaactcagtgtttctgcaaatgaacagcctgagagtcgaggactcggctgtctactactgtgcgaggaataagggagctacctacgatttggacac

SEQ ID NO: 453548 - DNA, 503 bp, Homo sapiens
  misc_feature: HEFZJCU01BY17Q.10.23.C01.1.454.heavy.3.raw
catagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcagctttgatgaatatgccatggactgggtccggcaagttccagggaagggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagagggagtcagggtttctaaa

SEQ ID NO: 453549 - DNA, 505 bp, Homo sapiens
  misc_feature: HEFZJCU01D381C.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttccccctggcaccctcctccaagagcacctctgggggcacagcggccctgggctgcctggtcaaggactacttcctacgtcgtat

SEQ ID NO: 453550 - DNA, 516 bp, Homo sapiens
  misc_feature: HEFZJCU01BO8ZP.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaatgaacagcctaagtcctgaggacacgggtgtatactactgtacgaaggaggggggaaccagcgggagttccaagtacttcc

SEQ ID NO: 453551 - DNA, 486 bp, Homo sapiens
  misc_feature: HEFZJCU01DRQ48.4.46.E02.1.454.heavy.3.raw
agcactgtagcacgaccggtgctcgatttagactcatctacagggaaagggtcagtgaaggtctcctgcaaggcttttggttactcctttaacagaaacgctatcagctgggtgcgacaggcccctggacaagggcttgagtggctgggatggatcagcgcttacaatggtaacacaaactatgcacagaagctccagggtagagtcaccatgaccacagacacatccacgaacacagcctacatggagttgaggagcctgagatctgacgacacggccatgtattactgtgcgagagacccacgatgggaggggggagcattggctggttccgggcaaggctactggggccagggaaccctggtcatcgtctcctcagcctccaccaagggcccatcggtcttccccctggcacctcctccaagagcacctctgggggcacagcggccctgggctgcctggtcaggactacttccctacagtgct

SEQ ID NO: 453552 - DNA, 498 bp, Homo sapiens
  misc_feature: HEFZJCU01BSQ14.40.81.H04.1.454.heavy.3.raw
tctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcgggactgacctctgacgacacggccatgtattactgtggaagagacgttggtggctaccgcggggctggaccactc

SEQ ID NO: 453553 - DNA, 396 bp, Homo sapiens; identical to SEQ ID NO: 445818
  misc_feature: HEFZJCU01ET1P3.16.68.G02.1.454.heavy.3.raw

SEQ ID NO: 453554 - DNA, 504 bp, Homo sapiens
  misc_feature: HEFZJCU01BPTJL.11.19.B08.1.454.heavy.3.raw
cgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctggggggaagcttggtacagcctggagggtccctgagactcttctgtgcagcctctggattcgactttagtagttatgaaatgaactgggtccgccaggctccagggaaggggctggagtgggtttcatacatttctagtaattctggtaccatacactatgcagtctctgtgaagggccgattcaccatctccagagacaacgccaggaactcactttatctgcaaatgagcagcctgagagtcgaggacacgggtatttattactgtgcgagagatagtctgtctatgcttccgggagctaact

SEQ ID NO: 453555 - DNA, 495 bp, Homo sapiens
  misc_feature: HEFZJCU01B9644.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactaatggagactccttcaagggccgattcaccatctccagagacaattccaagaacatggtgtatctgcaaatgaccagcctgagagccgaggacacgggtgtttattactgtgggagaatcctagtggc

SEQ ID NO: 453556 - DNA, 491 bp, Homo sapiens
  misc_feature: HEFZJCU01ALVKB.4.21.B10.1.454.heavy.3.raw
agcactgtagcacgaccggtgctcgatttagtgtcgtcgcaagagaggggggtcccttagactctcctgtgcagtctctggactcaacctcaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcgccctgggctgcctggtcaaggactactccctacagtgct

SEQ ID NO: 453557 - DNA, 482 bp, Homo sapiens
  misc_feature: HEFZJCU01AH6E0.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggctacttcctagagacacg

SEQ ID NO: 453558 - DNA, 387 bp, Homo sapiens; identical to SEQ ID NO: 444635
  misc_feature: HEFZJCU01CCQFM.11.27.C05.1.454.heavy.3.raw

SEQ ID NO: 453559 - DNA, 514 bp, Homo sapiens; identical to SEQ ID NO: 446900
  misc_feature: HEFZJCU01EK9IS.10.53.E09.1.454.heavy.3.raw

SEQ ID NO: 453560 - DNA, 508 bp, Homo sapiens
  misc_feature: HEFZJCU01EHQIS.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgtggggcctaac

SEQ ID NO: 453561 - DNA, 511 bp, Homo sapiens; identical to SEQ ID NO: 446799
  misc_feature: HEFZJCU01A9VMC.18.39.D06.1.454.heavy.3.raw

SEQ ID NO: 453562 - DNA, 531 bp, Homo sapiens; identical to SEQ ID NO: 446857
  misc_feature: HEFZJCU01E0MH9.7.78.H01.1.454.heavy.3.raw

SEQ ID NO: 453563 - DNA, 480 bp, Homo sapiens
  misc_feature: HEFZJCU01D0536.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggccatcgtcttcccctggcgccctgctccaggagcacctccgagagcacagcggccctgggctgcctggtcaaggactacttcctacgtgagct

SEQ ID NO: 453564 - DNA, 518 bp, Homo sapiens
  misc_feature: HEFZJCU01DWFCC.48.57.F02.1.454.heavy.3.raw
agtatacatacacgaccggtgctcgatttagctcgatatagttgggtttggggatttagatgtctgtgttgggtttggggggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggcgccctgctccaggagcacctccgagagcacagcggccctcgggctgcctggtcaaggactacttcctatgtata

SEQ ID NO: 453565 - DNA, 528 bp, Homo sapiens
  misc_feature: HEFZJCU01E0YUO.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggttccaccgtctcctcagcctccacc

SEQ ID NO: 453566 - DNA, 480 bp, Homo sapiens; identical to SEQ ID NO: 446171
  misc_feature: HEFZJCU01CVXYA.22.36.D03.1.454.heavy.3.raw

SEQ ID NO: 453567 - DNA, 520 bp, Homo sapiens
  misc_feature: HEFZJCU01C2KT7.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaatgaacaccctgcgagccgaggacacggccgtatattactgtgcgagaataacccgttcgcctggttatttacc

SEQ ID NO: 453568 - DNA, 516 bp, Homo sapiens
  misc_feature: HEFZJCU01BJX20.19.67.G01.1.454.heavy.3.raw
  modified_base (482)..(482): a, c, t, g, unknown or other
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacgggccgtctattattgtgtgagagttttanggcgatggctggtggacagatcactggggccaac

SEQ ID NO: 453569 - DNA, 522 bp, Homo sapiens; identical to SEQ ID NO: 449550
  misc_feature: HEFZJCU01D04UI.12.40.D07.1.454.heavy.3.raw

SEQ ID NO: 453570 - DNA, 513 bp, Homo sapiens
  misc_feature: HEFZJCU01DVX73.22.86.H09.1.454.heavy.3.raw
acatacgcgtcacgaccggtgctcgatttagtgctatagacttgggtttgggctgagcgtggtttcgtcgtagctctttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcgttttgatctctggggccaaggggacactggtcaccgtctcttcagcctccaccaaacgggcccatcggtcttccccctggccgtccgtgctccaggacg

SEQ ID NO: 453571 - DNA, 516 bp, Homo sapiens
  misc_feature: HEFZJCU01D7ZM5.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaactttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcacccctgggccagggaaccctggtcaccgtctcctcagcctccaccaaggcccatcggtcttcccctggcaccctcctccaagagcacctctggggcacagcggccctgggctgcctggtcaaggactactccgagtagtacacg

SEQ ID NO: 453572 - DNA, 511 bp, Homo sapiens
  misc_feature: HEFZJCU01DD9BA.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgttttggccggtgaactactggggccagggcaccctggtcaccgtctcctcagcttccaccaagggcccatcggtcttccccctggcgccctgctccaggagcacctctgggggcacagcggccctgggctgcctggtcaaggactactcccatac

SEQ ID NO: 453573 - DNA, 380 bp, Homo sapiens
  misc_feature: HEFZJCU01CLA38.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatgggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 453574 - DNA, 507 bp, Homo sapiens; identical to SEQ ID NO: 453186
  misc_feature: HEFZJCU01BB1DJ.48.81.H04.1.454.heavy.3.raw

SEQ ID NO: 453575 - DNA, 501 bp, Homo sapiens; identical to SEQ ID NO: 445341
  misc_feature: HEFZJCU01AVJWR.48.34.D01.1.454.heavy.3.raw

SEQ ID NO: 453576 - DNA, 509 bp, Homo sapiens
  misc_feature: HEFZJCU01BPLVA.17.33.C11.1.454.heavy.3.raw
cgtagactagcacgaccggtgctcgatttagagtgagctcgttgggtttggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggactctggtcaccgtctccgcagcctccaccaagggccc

SEQ ID NO: 453577 - DNA, 514 bp, Homo sapiens
  misc_feature: HEFZJCU01DPN41.26.12.B01.1.454.heavy.3.raw
agactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccagggaggggcctggagtgggtctcaggtatcagttacaatagtggtaatatactctatgcggactctgtgaagggccgattcaccatctccagagacaacgccaggaactccctctatctagaaatggacagtctgacaactgagacacggccttttatttctgtgcaaaggtggaaccgacatatttcacaagctggcactggtacttcg

SEQ ID NO: 453578 - DNA, 522 bp, Homo sapiens; identical to SEQ ID NO: 446788
  misc_feature: HEFZJCU01EFWEE.12.40.D07.1.454.heavy.3.raw

SEQ ID NO: 453579 - DNA, 507 bp, Homo sapiens
  misc_feature: HEFZJCU01BIQJK.53.33.C11.1.454.heavy.3.raw
cgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgaccctgggccagggaaccctggtcaccgtctcctcagcttccaccaagggcccatcggtcttcccctcggcgcccg

SEQ ID NO: 453580 - DNA, 494 bp, Homo sapiens
  misc_feature: HEFZJCU01EG8TA.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtgctacgagtactggtacttcgatctctgggccgtggcaccctgctgactgtctcctcagcctccaccaagggcccatcggtcttcccctggcgccctgctccaggagcacctccgagagcacagcggcctgggctgcctggtcaaggactacg

SEQ ID NO: 453581 - DNA, 313 bp, Homo sapiens
  misc_feature: HEFZJCU01BRVPK.49.76.G10.1.454.heavy.3.raw
agtcgagagacacgaccggtgctcgatttagtcactcatacagggacaattccgagaacacgctgtatctgcaaatgaacagcctgagagctgaggacacggctgtgtattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagagcacctctgggggcacagcggccctgggctgcctggtcaaggactacttcctctctcgact

SEQ ID NO: 453582 - DNA, 407 bp, Homo sapiens
  misc_feature: HEFZJCU01DQFLW.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttcccctggcgccctgctccaggagcacctctgggggcacagcggcctgggctgcctggtcaaggactacttccgagtgcgtct

SEQ ID NO: 453583 - DNA, 395 bp, Homo sapiens; identical to SEQ ID NO: 444923
  misc_feature: HEFZJCU01B5ZS0.16.68.G02.1.454.heavy.3.raw

SEQ ID NO: 453584 - DNA, 525 bp, Homo sapiens
  misc_feature: HEFZJCU01AMRVK.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgatttttggagtggccttgataactggggccaggggatcctggtcaccgtctcctcagcctccaccaac

SEQ ID NO: 453585 - DNA, 513 bp, Homo sapiens
  misc_feature: HEFZJCU01EA8SE.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagcgtggcgttttcttagtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccac

SEQ ID NO: 453586 - DNA, 514 bp, Homo sapiens; identical to SEQ ID NO: 451806
  misc_feature: HEFZJCU01AV8HW.19.67.G01.1.454.heavy.3.raw

SEQ ID NO: 453587 - DNA, 517 bp, Homo sapiens
  misc_feature: HEFZJCU01DOBMK.3.20.B09.1.454.heavy.3.raw
agacgcactccacgaccggtgctcgatttagtgtagtgtgaagggacaggggtctccgaaggcttcacctcgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggacaatggtcaccgtctcttcagcctccaccaagggcccatcggtcttcccctggcaccctcctccaagagcacctctgggggcacagcggcccg

SEQ ID NO: 453588 - DNA, 489 bp, Homo sapiens; identical to SEQ ID NO: 444791
  misc_feature: HEFZJCU01DM3FQ.47.85.H08.1.454.heavy.3.raw

SEQ ID NO: 453589 - DNA, 390 bp, Homo sapiens; identical to SEQ ID NO: 444541
  misc_feature: HEFZJCU01EQ0D9.16.24.C02.1.454.heavy.3.raw

SEQ ID NO: 453590 - DNA, 494 bp, Homo sapiens
  misc_feature: HEFZJCU01EE6WB.10.75.G09.1.454.heavy.3.raw
catagtagtgcacgaccggtgctcgatttagtatagacatcagggtctccctcactgcccagctgggatctcagggcttcattttctgtcctccaccatcatggggtcaaccgccatcctcgccctcctcctgactgttctccaaggtcagtcctgccgagggcttgaggtcacagaggagaacgggtggaaaggagccccggattcaaattttggttcccccccacaggagtctgtgccgaggtgcagctggtgcagtcaggagcagaggtaaagaggcccggggagtctctgaagatctcctgtaaggcctctggattcatgtttagccactcctggatcggctgggtgcgccagatgcccgggaaaggcctggagtggatggggatcatctggcctagtgactctgatatcagatacagtccgtccttccaaggccaggtcaccatctcagccgacaagtccatcagcaccgcctatctgcagtggagtag

SEQ ID NO: 453591 - DNA, 506 bp, Homo sapiens; identical to SEQ ID NO: 449521
  misc_feature: HEFZJCU01BTPKH.13.39.D06.1.454.heavy.3.raw

SEQ ID NO: 453592 - DNA, 511 bp, Homo sapiens; identical to SEQ ID NO: 445871
  misc_feature: HEFZJCU01B2Z1P.14.25.C03.1.454.heavy.3.raw

SEQ ID NO: 453593 - DNA, 535 bp, Homo sapiens
  misc_feature: HEFZJCU01BA0DE.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaagtaatggctgtgtttattggggccagggagccctggtcaccg

SEQ ID NO: 453594 - DNA, 533 bp, Homo sapiens
  misc_feature: HEFZJCU01CW2LM.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctattcttcaaatggacagcctgaaagacgaagacacgggcgtgtatttttgtgtgaaagatacgaagtctatgatacccaatttgggaggggcctttcatgtctgggccaagggacgctggtcaccgtctcttcagcctccaccaaggccatcggtcttcccctggcaccctcctccaagagcacctctgggggcacagcc

SEQ ID NO: 453595 - DNA, 524 bp, Homo sapiens
  misc_feature: HEFZJCU01D7ZJV.18.33.C11.1.454.heavy.3.raw
  modified_base (234)..(234): a, c, t, g, unknown or other
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttanagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaaccctggtcaccgtctccccaccctccaccaagggcccatcggtcttcccctggcaccctcctccaagagcacctctgggggcacagcggccctgggctgcctggtcaaggactactcccatactcgta

SEQ ID NO: 453596 - DNA, 519 bp, Homo sapiens; identical to SEQ ID NO: 446650
  misc_feature: HEFZJCU01DZU31.13.76.G10.1.454.heavy.3.raw

SEQ ID NO: 453597 - DNA, 489 bp, Homo sapiens
  misc_feature: HEFZJCU01C3ZED.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaaggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggcctgggctgcctggtcaaggactacttcccacgagagta

SEQ ID NO: 453598 - DNA, 497 bp, Homo sapiens
  misc_feature: HEFZJCU01C70FP.12.14.B03.1.454.heavy.3.raw
atacgacgtacacgaccggtgctcgatttagtgtgagtagttccgcggggggggaggcttggttcggcctggcgggtccctgagactctcctgcgcagcctctggattcctttttgaggatttgccatgcactgggtccggcaagctccggggaggggcctggagtgggtctcaacaattacttggaatagtgctaccatagcctacacagactccgtgaaggggccgattcatcacttctagagacaacgccgagaactccctgtatctgcagatgaacagtctgagacctgaggacacggccctgtatttctgttcaaaggggctctggttcagggatggggctttgactcctgggcccagggaaccctggtcgcggtctcctcagcctccaccaagggcccatcggtcttccccctggcaccctcctccaagagcacctctgggggcacagcggccctgggctgcctggtcaaggactacttcctacgtcgtat

SEQ ID NO: 453599 - DNA, 521 bp, Homo sapiens; identical to SEQ ID NO: 445317
  misc_feature: HEFZJCU01CZKTQ.12.40.D07.1.454.heavy.3.raw

SEQ ID NO: 453600 - DNA, 532 bp, Homo sapiens; identical to SEQ ID NO: 445228
  misc_feature: HEFZJCU01EDWY9.7.78.H01.1.454.heavy.3.raw

SEQ ID NO: 453601 - DNA, 482 bp, Homo sapiens
  misc_feature: HEFZJCU01DQ8L8.40.71.G05.1.454.heavy.3.raw
tctagcgactcacgaccggtgctcgatttagtgtcgtcgcaagagagaggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttaccgactatggtatgagctgggtgcgacaggcccccggacaagggcttgagtggatgggatggagcagcacttacaatggtgacacaaactatgcacagaagttccaggacagagtcaccatgaccacagacacatccaccagcacagcctatatggaggtgaggagcctgacatctgacgacacggccgtatattactgtgcgagagatcatcggaggtggaatgccgtgt

SEQ ID NO: 453602 - DNA, 522 bp, Homo sapiens
  misc_feature: HEFZJCU01BVKCF.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaatattggtgggctggatccgccagcccccaggaaggggctggaatggattgggagtatattttataattgggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagtacggttttgattatttggggccaagggacaaggggtcaccgtctccgcagcctccacccg

SEQ ID NO: 453603 - DNA, 499 bp, Homo sapiens
  misc_feature: HEFZJCU01DDVQ8.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtgcaactcctatgcttttgatatctggggccaagggac

SEQ ID NO: 453604 - DNA, 527 bp, Homo sapiens
  misc_feature: HEFZJCU01EI9H8.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctcccttgacttctgggccatggaacccggtcc

SEQ ID NO: 453605 - DNA, 488 bp, Homo sapiens
  misc_feature: HEFZJCU01B9IYU.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctgtcaaggactacttcctacgtgagct

SEQ ID NO: 453606 - DNA, 522 bp, Homo sapiens
  misc_feature: HEFZJCU01CXLG9.12.71.G05.1.454.heavy.3.raw
  modified_base (480)..(480): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccaggggaacccaggtcaccgtctcctcagcctccaccaagggcccatcccgtcttccccctggccgccctgctccaggagcacctccgngagcacagcgtcctgggctgcctggtcaggactactcctacg

SEQ ID NO: 453607 - DNA, 498 bp, Homo sapiens
  misc_feature: HEFZJCU01AQZGZ.51.78.H01.1.454.heavy.3.raw
cgatcgtatacacgaccggtgctcgatttagtgtgagtagtttgggtttgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggccaccctcctccaagagcacctctgggggcacagcggccctgggctgcctggtcaaggactacttcctcgtagcact

SEQ ID NO: 453608 - DNA, 544 bp, Homo sapiens
  misc_feature: HEFZJCU01ES43C.8.25.C03.1.454.heavy.3.raw
ctcgcgtgtccacgaccggtgctcgatttagtagtgtagatttgggtttggggggagaggagccccagccgtgagattcccaggagtttccacttggtgatcagcactgaacacagaccaccaaccatggagtttgggcttacctgggttttccttgttgctattttaaaaggtgtccagtgtgaggtgcagctggtggactctgggggaggcttggtacagccagggcggtccctgagactctcctgtacagggactggattcatctttggtgactatgctgtgacctgggtccgccaggctccagggaaggggctggagtgggtaagtctcattagaagtaaagcttatggtgggacaacagattacgccgcgtctgtgaaaggcagattcaccatctcaagagatgattccaaaagcatcgcctttctacaaatggacagcctagaaaaccgaggacacaggcgtgtattactgcaacaggtttggttcgggaaatccgacaaaatgacctcgtggggccagggaaccctggtcaccgtct

SEQ ID NO: 453609 - DNA, 471 bp, Homo sapiens
  misc_feature: HEFZJCU01AUIIO.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggccgccctgctccaggagcacctccgagagcacagcggccctgggctgcctggtcaaggactacttccctacagtgct

SEQ ID NO: 453610 - DNA, 491 bp, Homo sapiens; identical to SEQ ID NO: 446104
  misc_feature: HEFZJCU01BIJAS.3.34.D01.1.454.heavy.3.raw

SEQ ID NO: 453611 - DNA, 509 bp, Homo sapiens; identical to SEQ ID NO: 444586
  misc_feature: HEFZJCU01DYJ69.12.78.H01.1.454.heavy.3.raw

SEQ ID NO: 453612 - DNA, 392 bp, Homo sapiens; identical to SEQ ID NO: 444456
  misc_feature: HEFZJCU01ARR6T.7.60.F05.1.454.heavy.3.raw

SEQ ID NO: 453613 - DNA, 510 bp, Homo sapiens
  misc_feature: HEFZJCU01C0CTR.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaagggccccatcggtctttcccctggccgccctgctccaggagcacctcgtggggcacagccggccctgggctgcctggtcaggactactccat

SEQ ID NO: 453614 - DNA, 508 bp, Homo sapiens; identical to SEQ ID NO: 446331
  misc_feature: HEFZJCU01CSGXA.51.5.A05.1.454.heavy.3.raw

SEQ ID NO: 453615 - DNA, 504 bp, Homo sapiens
  misc_feature: HEFZJCU01ASQ3K.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccaagagcacctctgggggcacagcggccctgggctgcctggtcaaggactacttccacgtcgtat

SEQ ID NO: 453616 - DNA, 481 bp, Homo sapiens; identical to SEQ ID NO: 445006
  misc_feature: HEFZJCU01ENHGR.7.10.A10.1.454.heavy.3.raw

SEQ ID NO: 453617 - DNA, 383 bp, Homo sapiens; identical to SEQ ID NO: 444673
  misc_feature: HEFZJCU01DK9ZL.11.61.F06.1.454.heavy.3.raw

SEQ ID NO: 453618 - DNA, 481 bp, Homo sapiens; identical to SEQ ID NO: 448054
  misc_feature: HEFZJCU01EZ1BX.22.36.D03.1.454.heavy.3.raw

SEQ ID NO: 453619 - DNA, 490 bp, Homo sapiens
  misc_feature: HEFZJCU01BDGDR.13.55.E11.1.454.heavy.3.raw
tcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccaggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagataccaaccccttacg

SEQ ID NO: 453620 - DNA, 505 bp, Homo sapiens; identical to SEQ ID NO: 451682
  misc_feature: HEFZJCU01CFUHW.10.38.D05.1.454.heavy.3.raw

SEQ ID NO: 453621 - DNA, 529 bp, Homo sapiens
  misc_feature: HEFZJCU01C0L6N.48.33.C11.1.454.heavy.3.raw
agtatacatacacgaccggtgctcgatttagagtgagctcgttgggtttgggtgccgaagttgctggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctcccgagagcacagcggccctgggctgcctggtcaaggactacttcctatgtatact

SEQ ID NO: 453622 - DNA, 444 bp, Homo sapiens
  misc_feature: HEFZJCU01C5EA0.3.86.H09.1.454.heavy.3.raw
agacgcactccacgaccggtgctcgatttagtgctatagacttgggtttgggattcacgttgcagatgtaggtctgggtgcgacaggctcctggaaaagggcttgagtggatgggaggttttgatcctgaagagcgtgaaagaatctacgcacagaatttccagggcagagtcaacatgaccgaggacacatccacagacacatcctacatggagttgaccagcctgagatctgaagacacggccgtgtattattgtgcaacagtcgcggctagcgcagcgggccctgatgcttttgatatctggggcccagggacattggtcaccgtctcttcagcctccaccaagggcccatcggtcttccccctggcaccctcctccaagagcacctctggggcacagcggccctgggctgcctggtcaaggactacttccgagtgcgtct

SEQ ID NO: 453623 - DNA, 536 bp, Homo sapiens
  misc_feature: HEFZJCU01B4L5W.13.88.H11.1.454.heavy.3.raw
tcacgtactacacgaccggtgctcgatttagcgacagcgagaacacacaaagggggggattcccaagtgttttcattcagtgatcaggactgaacacagaggactcaccatggagtttgggctgagctggattttccttggtgtttttttaaaaggtgtccactgtgagctgcagctggtggagtctggggggggcttggtaaagcctggggggtcccttacactctcctgtgtagcctctaaaatcactttcaacgacgcctggatgagctgggtccgccaggcgccagggaggggactggagtgggttggccgtattaaaagcgaggccgatggtgggacagcagacttcgctgcacccgtgcaagccagattcaccctctcaagacatgatttagagaatactgtgtatttgcaaatgaacagcttgacaaccgaggacgcaggcgtttattactgtgccagtagttccacctggccactctacttctttgacttctggggccagggaaccctggtcgccgtctcctcagctt

SEQ ID NO: 453624 - DNA, 483 bp, Homo sapiens; identical to SEQ ID NO: 444639
  misc_feature: HEFZJCU01EWSTN.11.23.C01.1.454.heavy.3.raw

SEQ ID NO: 453625 - DNA, 500 bp, Homo sapiens; identical to SEQ ID NO: 444529
  misc_feature: HEFZJCU01DHR23.12.38.D05.1.454.heavy.3.raw

SEQ ID NO: 453626 - DNA, 521 bp, Homo sapiens
  misc_feature: HEFZJCU01DWU4C.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggccggggaaccctggtcaccgtctcccaccctccaccaagggcccatcggtcttccccctggcaccctcctccagagcacctctgggggcacagcggccctggctgcctggtcaaggactactccatactcgta

SEQ ID NO: 453627 - DNA, 517 bp, Homo sapiens
  misc_feature: HEFZJCU01B11O8.19.67.G01.1.454.heavy.3.raw
tactctcgtgcacgaccggtgctcgatttagagtatacatattggggtttggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagtagtttatggcgatggctgggtggacaggatcacgtgggggaccac

SEQ ID NO: 453628 - DNA, 325 bp, Homo sapiens
  misc_feature: HEFZJCU01EELD0.47.38.D05.1.454.heavy.3.raw
agctcacgtacacgaccggtgctcgatttagtatctgatagttgggtttgggtgcccaagctgctggagggcacggtcaccacgctgctgagcagtctgagacctgacgacacggccgtgtattattgtgcgttagttacggacgattacgacgtttttgattggttcattacccggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 453629 - DNA, 502 bp, Homo sapiens
  misc_feature: HEFZJCU01B77FA.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagtttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcgagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctacaattctgggg

SEQ ID NO: 453630 - DNA, 505 bp, Homo sapiens
  misc_feature: HEFZJCU01CBFA2.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagcgtgcgttttcttagtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcacctatctccagagacaattccaagaacacactgtatctgcaaatgaacagcctgagagccgacgacacggccatatattactgtgcgaaagcaccggcagttagtcacccatactactttgactact

SEQ ID NO: 453631 - DNA, 502 bp, Homo sapiens
  misc_feature: HEFZJCU01BVZH8.11.67.G01.1.454.heavy.3.raw
cgagagataccacgaccggtgctcgatttagagtatacatattgggtttggggagctctgagagaggagcccagccctgggattttcaggtgttttcatttggtgatcaggactgaacagagagagctcaccatggagtttgggctgagctggctttttcttgtggctattttaaaaggtgtccagtgtgaggtggagttattgcagtctggggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgca

SEQ ID NO: 453632 - DNA, 501 bp, Homo sapiens; identical to SEQ ID NO: 445341
  misc_feature: HEFZJCU01DZ1TJ.48.34.D01.1.454.heavy.3.raw

SEQ ID NO: 453633 - DNA, 449 bp, Homo sapiens; identical to SEQ ID NO: 444889
  misc_feature: HEFZJCU01DPH6L.9.53.E09.1.454.heavy.3.raw

SEQ ID NO: 453634 - DNA, 513 bp, Homo sapiens
  misc_feature: HEFZJCU01B0VTI.16.38.D05.1.454.heavy.3.raw
tgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagttttcctatgcactggatccgccaggctccaggcaggggactggagtgggtggcaggagtgtcacttgatggagccaatacatacttcgcagactccgtgaagggccgattcaccatttccagagagaattccaacaacacgctgcatctgcaaatggacaccctgagacctgacgacacggctgtctattactgtgtgagactcttattgcgttcgggctttgactactgggccagggatccctggtcaccgtctcctcagcctccaccaaggcccatcggtcttcccctc

SEQ ID NO: 453635 - DNA, 523 bp, Homo sapiens
  misc_feature: HEFZJCU01D4BOZ.5.33.C11.1.454.heavy.3.raw
atcagacacgcacgaccggtgctcgatttagagtgagctcgttgggtttgggggaggcttggtccagcctggggggtccctgagactctcctgtgtagcctccggattcacctttagtgcctattggatgacctgggtccgccaggctccagggaaggggctggagtgggtggccaatataagattcgatggaagtgaggtgtactatgtggactctgtgaagggccgattcaccatctccagagacaacgccgagaactcactgtatctccaaatgaacagcctgagagccgaggacacggctgtctactactgtacgaatatcccctcgttttacgatttttggactggcccgttggggtactcctacggtttggacgtctgggccaagggaccacggtcaccgtctcctcagcctccaccaagggcccatcggtcttcccctggcgccctgctccaggagcacctccgagagcacagcggccctgggctgcctggtcaaggactacttcccgtgtctgat

SEQ ID NO: 453636 - DNA, 415 bp, Homo sapiens; identical to SEQ ID NO: 444794
  misc_feature: HEFZJCU01CLVQ5.14.74.G08.1.454.heavy.3.raw

SEQ ID NO: 453637 - DNA, 506 bp, Homo sapiens; identical to SEQ ID NO: 452514
  misc_feature: HEFZJCU01DZW1S.51.56.F01.1.454.heavy.3.raw

SEQ ID NO: 453638 - DNA, 507 bp, Homo sapiens
  misc_feature: HEFZJCU01B9R3V.47.23.C01.1.454.heavy.3.raw
agctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggcccccggacagagacctgagtggatgggatggatcagcattggcaatggtaacataaaacactcacagaagttccagggcagggtcaccattaccagagacatctccgcgaccacagcctacatggaactgagcagcctgacttctgaagacacggctatttactactgtgcgagagaggggtttgactggaactccttctacatggacgtctgggggcaaagggaccg

SEQ ID NO: 453639 - DNA, 525 bp, Homo sapiens
  misc_feature: HEFZJCU01CH9L9.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattccccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctcccaagagcacctcctgggggcacagcggccctgggctgcctggttcaagggactaacttccagacgtatca

SEQ ID NO: 453640 - DNA, 519 bp, Homo sapiens
  misc_feature: HEFZJCU01EB7ZH.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggaccc

SEQ ID NO: 453641 - DNA, 468 bp, Homo sapiens; identical to SEQ ID NO: 448722
  misc_feature: HEFZJCU01BGAHO.4.10.A10.1.454.heavy.3.raw

SEQ ID NO: 453642 - DNA, 527 bp, Homo sapiens
  misc_feature: HEFZJCU01AJILM.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgttttattttgtacgagagcgtcgtctgtcagtggaattgactactggggccagggaaccctggtcaccgtctcctcagcctccacc

SEQ ID NO: 453643 - DNA, 379 bp, Homo sapiens; identical to SEQ ID NO: 444450
  misc_feature: HEFZJCU01AUX3W.47.77.G11.1.454.heavy.3.raw

SEQ ID NO: 453644 - DNA, 496 bp, Homo sapiens
  misc_feature: HEFZJCU01B58Q4.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgagtacggctgtctatcattgtgttttcgatcgccttcggtccgcggacttcgt

SEQ ID NO: 453645 - DNA, 534 bp, Homo sapiens
  misc_feature: HEFZJCU01CQ268.3.70.G04.1.454.heavy.3.raw
agacgcactccacgaccggtgctcgatttagtgtagtgtgaagggaaagggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactggaggaggcttgatccagcccggggggtccctgagactctcctgtgaagtctctgggttcactgtcagtagcaactacatgaactgggtccgccaggctccagggaaggggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatgtgggtgttaactggggcctgggaaccctggtcaccgtctcctcag

SEQ ID NO: 453646 - DNA, 400 bp, Homo sapiens; identical to SEQ ID NO: 444452
  misc_feature: HEFZJCU01EX180.47.24.C02.1.454.heavy.3.raw

SEQ ID NO: 453647 - DNA, 509 bp, Homo sapiens
  misc_feature: HEFZJCU01C5PH4.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccagatccggtgagcctacggcagcggcctttgacttctgggggccaggggacg

SEQ ID NO: 453648 - DNA, 517 bp, Homo sapiens; identical to SEQ ID NO: 453023
  misc_feature: HEFZJCU01C0SUK.7.78.H01.1.454.heavy.3.raw

SEQ ID NO: 453649 - DNA, 503 bp, Homo sapiens
  misc_feature: HEFZJCU01DBI0Y.53.61.F06.1.454.heavy.3.raw
cgcgtatacacacgaccggtgctcgatttagctacgctctaagggaaagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcacatctcgagagacaattccaggaacacgctgtatctgcaatgaacggcctgagagctgaggacacggctgtgtattactgtgcgaaacggtttgaggtgggaattaggggc

SEQ ID NO: 453650 - DNA, 536 bp, Homo sapiens; identical to SEQ ID NO: 453137
  misc_feature: HEFZJCU01EENUN.14.57.F02.1.454.heavy.3.raw

SEQ ID NO: 453651 - DNA, 486 bp, Homo sapiens
  misc_feature: HEFZJCU01AM0OD.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgcctgctcaggagcacctccgagagcacagcggccctggctgcctggtcaaggactacttcctacgtgagct

SEQ ID NO: 453652 - DNA, 491 bp, Homo sapiens
  misc_feature: HEFZJCU01DM9OQ.40.81.H04.1.454.heavy.3.raw
tctagcgactcacgaccggtgctcgatttagtagtgtagattcgcgggcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactggacctctgacgacacggccatgtatta

SEQ ID NO: 453653 - DNA, 463 bp, Homo sapiens
  misc_feature: HEFZJCU01EO4MR.9.30.C08.1.454.heavy.3.raw
tgatacgtctcacgaccggtgctcgatttagtctgacgtcaaagggaaagggttgtagtaggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 453654 - DNA, 501 bp, Homo sapiens; identical to SEQ ID NO: 447123
  misc_feature: HEFZJCU01CT8AO.3.20.B09.1.454.heavy.3.raw

SEQ ID NO: 453655 - DNA, 372 bp, Homo sapiens
  misc_feature: HEFZJCU01B88A6.3.1.A01.1.454.heavy.3.raw
agacgcactccacgaccggtgctcgatttagacgtctcatccatcagtagtactagtagtaacatatactacgaagactcagtgaagggccgattcaccatctccagagacaaagccaagaactcactgtatctggaaatgaacagcctgagagccgaggacacggctgtgtattactgtgcgagagggcggctttggggttcaggaccgtcctacgctagtggacgtctggggccaagggaccacggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 453656 - DNA, 489 bp, Homo sapiens
  misc_feature: HEFZJCU01AUQZ8.48.20.B09.1.454.heavy.3.raw
agtatacatacacgaccggtgctcgatttagtgtagtgtgaaggggctccctcactgcccagctgggatctcagggcttcattttctgtcctccaccatcatggggtcaaccgccatcctcgccctcctcctggctgttctccaaggagtctgtgccgaggtgcagctggtgcagtctggagcacaattgaaaagcccggggagtctctgaagatctcctgtgagggttctggatacagctttgccaactactggatcgcctgggtgcgccagatgcccgggaaaggcctggagtggatggggatcatctatcctggcgactctgataccagatacagcccgtccttccaaggccaagtcaccatctcagccgacaactccatcagcaccgcctacctgcagtggagcagcctgaaggcctcggacaccgccgtgtattactgtgcgagacatgattacggctactcacgtccgcactactggggccac

SEQ ID NO: 453657 - DNA, 396 bp, Homo sapiens; identical to SEQ ID NO: 444469
  misc_feature: HEFZJCU01AKH0C.47.46.E02.1.454.heavy.3.raw

SEQ ID NO: 453658 - DNA, 479 bp, Homo sapiens; identical to SEQ ID NO: 447128
  misc_feature: HEFZJCU01CJM8K.4.37.D04.1.454.heavy.3.raw

SEQ ID NO: 453659 - DNA, 491 bp, Homo sapiens; identical to SEQ ID NO: 444592
  misc_feature: HEFZJCU01D9DZN.11.26.C04.1.454.heavy.3.raw

SEQ ID NO: 453660 - DNA, 524 bp, Homo sapiens; identical to SEQ ID NO: 446153
  misc_feature: HEFZJCU01CMB2E.12.86.H09.1.454.heavy.3.raw

SEQ ID NO: 453661 - DNA, 519 bp, Homo sapiens
  misc_feature: HEFZJCU01D496G.13.25.C03.1.454.heavy.3.raw
tcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctgaggcctcagtgaaggtctcctgcaaggcttccggatacaccctcaatggaaactatgtccactatgtgcgacaggccccaggacaagggcttctgtggatggggtggatcaaccctaatagtggtgacacaaactatgagaagaaatttgagggccgggtcaccatgaccagggacacgtccatcaatacagccttcatggaactgaccagactgacctctgacgacacggccgtgtattactgtgcggtcgaaactcagcctaactacttgtaattttggggccagggagccctggtcaccgt

SEQ ID NO: 453662 - DNA, 515 bp, Homo sapiens
  misc_feature: HEFZJCU01C2Z4M.48.26.C04.1.454.heavy.3.raw
agtatacatacacgaccggtgctcgatttagtctagcgactttgggtttggggacccaaaaaccacacccctccttgggagaatcccctagatcgacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccgatgaccacagacacatccacgagcacagcctacatggagctgaggagcctgagatctgacgacacggccgtgtattactgtgcgagagaagggtttacagtggttcggggagtctccgaccaggccaactggttccgacccc

SEQ ID NO: 453663 - DNA, 533 bp, Homo sapiens
  misc_feature: HEFZJCU01D5BTE.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtgggggcatttacttgacccctggggccggggaacccgtggtcaccgtctccccacccctccacccg

SEQ ID NO: 453664 - DNA, 505 bp, Homo sapiens; identical to SEQ ID NO: 447076
  misc_feature: HEFZJCU01A0XSS.10.38.D05.1.454.heavy.3.raw

SEQ ID NO: 453665 - DNA, 517 bp, Homo sapiens
  misc_feature: HEFZJCU01D4IB9.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtcgtgggggaggcttggtccagccagggcggtccctgagactctcctgtacagcgtctggattcaactttcgtgattatgccatgaactgggtccgccaggctccagggaagggctggagtgggtaggtttcattagagccatggcttatgctgggacaacagaatacgccgcgtctgtgaaggcagattcatcatctcaagagatgattccaacggcatcgcctatctgcagatagaacagcctagaagaccgaggacacacgaccgtctattactgtggttagggtaggttttacgtatttttggta

SEQ ID NO: 453666 - DNA, 399 bp, Homo sapiens
  misc_feature: HEFZJCU01DSUTE.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggatacttcctacgtgagct

SEQ ID NO: 453667 - DNA, 520 bp, Homo sapiens; identical to SEQ ID NO: 453029
  misc_feature: HEFZJCU01BML23.16.86.H09.1.454.heavy.3.raw

SEQ ID NO: 453668 - DNA, 382 bp, Homo sapiens
  misc_feature: HEFZJCU01EYXTV.11.61.F06.1.454.heavy.3.raw
cgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttccccctggcgccctgctccaggagcacctccgagagcacagcggccctgggctgcctggtcaaggactacttccgtatcttcg

SEQ ID NO: 453669 - DNA, 508 bp, Homo sapiens
  misc_feature: HEFZJCU01CNU8E.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctggggccagggaaccctggtcaccgtctcctcagcctccaccaaggcccatcggtcttcccctggcaccctcctccaagagcacctctgggggcacagcggccctgggctgcctggtcaaggactacttcgtact

SEQ ID NO: 453670 - DNA, 516 bp, Homo sapiens
  misc_feature: HEFZJCU01B5QQ9.17.33.C11.1.454.heavy.3.raw
  modified_base (391)..(391): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaaccaaggacacctccacaaaccaggtggtccttacaatgaccaattttanggaccctgtggacacagccacatattactgttcacgctctatggttcggggagttattagtccctactttgactactggggccagggaactctggtcaccgtctccgcagcctccaccaaggccc

SEQ ID NO: 453671 - DNA, 502 bp, Homo sapiens
  misc_feature: HEFZJCU01EI2WO.26.23.C01.1.454.heavy.3.raw
agactatactcacgaccggtgctcgatttagtacacgtgattagggattgggaggcgtggtccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttatttttgtgcgagagaggggtacagtagcggccgagctccggcctttgaccactggggccagggaaccctggtcaccgtctcctcagcctccaccaagggcccatcggtcttccccctggcgccctgctccaggagcacctccgagagcacagcggccctgggctgcctggtcaaggactacttccagtatagtct

SEQ ID NO: 453672 - DNA, 501 bp, Homo sapiens
  misc_feature: HEFZJCU01BVS10.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctggaccactggggccg

SEQ ID NO: 453673 - DNA, 516 bp, Homo sapiens
  misc_feature: HEFZJCU01DXW3A.3.6.A06.1.454.heavy.3.raw
agacgcactccacgaccggtgctcgatttagatctactgacagggggggaaatactttctgagagtcctggacctcctgtgcaagaacatgaaacatctgtggttcttccttctcctggtggcagctcccagatgtgtcctgtcccaggtgcacctgcaggagtcgggcccaggactggtgacgccttcggagaccctctccctcacctgcactgtctctggtggctccatcagtcgtttttactactactggagttggatccggcagtccccagggaagggactagagtgggttggccatatgcatcacagtgggagcaccaactacaacccctccctcgagagtcgagtcaccatatcaatagacacgtccaagaaccagttctccctgagcttgaagtctgtcaatgctgcggacacggccgtttattactgtgcgagtactgcggggaaagatccatttgatatttggggccaaggaacaatggtcaccgtctcttcagcctccaccaaggg

SEQ ID NO: 453674 - DNA, 495 bp, Homo sapiens
  misc_feature: HEFZJCU01CKE1L.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggttgcggtgactgctattgactactggggccagggaaccctggtcaccgtctcctcagcctccaccaaggcccatcggtcttcccctggcaccctcctccaagagcacctctgggggcacagcggccctgggctgcctggtcaaggactacttccgagtagtaca

SEQ ID NO: 453675 - DNA, 494 bp, Homo sapiens
  misc_feature: HEFZJCU01DEI84.49.21.B10.1.454.heavy.3.raw
agtcgagagacacgaccggtgctcgatttagtgtcgtcgcaagggggctctgggagacgagcccagcactggaaggcgccggtgtttccattcggtgatcagcactgaacacagaggactcaccatggagtttgggctgagctgggttttcctcgttggtcttttaagaggtgtccagtgttatgtgcagttggtggagtctgggggaggcgtggtccagcctgggaagtcactgagactcgcctgtacaccctctggattcaccttcagcaactatgcaatgcactgggtccgcctggctcccggcaagggtctggactgggtggcaggtatatcagctgatgggaccaaaatatactacgcaaactccgtgaagggccgattcaccatatcaagagacacttccgatgacacaatctatctgcaaatgaacagcctgaaagttgacgacacgggtctttttactgtgcgcctggaagcagtggctggccaca

SEQ ID NO: 453676 - DNA, 499 bp, Homo sapiens
  misc_feature: HEFZJCU01EPODR.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggcggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactgggccg

SEQ ID NO: 453677 - DNA, 504 bp, Homo sapiens
  misc_feature: HEFZJCU01D0PAA.53.24.C02.1.454.heavy.3.raw
cgcgtatacacacgaccggtgctcgatttagtacagatcgttagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagttgcgcagaagtttcagggcagggtcaccatgaccagggacacgtccatcagcactgcctacatggagctgaccaggctgaaatttgaggacgacggccgattttattactgtgcaaggaacagcataatgactccgtccccggtacttcgtacg

SEQ ID NO: 453678 - DNA, 524 bp, Homo sapiens
  misc_feature: HEFZJCU01C23NW.10.44.D11.1.454.heavy.3.raw
catagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctggggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccgagcgggagttccaagtactcctttgacgtctggggccgac

SEQ ID NO: 453679 - DNA, 491 bp, Homo sapiens; identical to SEQ ID NO: 451549
  misc_feature: HEFZJCU01BA3BT.49.17.B06.1.454.heavy.3.raw

SEQ ID NO: 453680 - DNA, 309 bp, Homo sapiens
  misc_feature: HEFZJCU01ANX6B.22.28.C06.1.454.heavy.3.raw
acatacgcgtcacgaccggtgctcgatttagagctcacgtattgggtttggggaagtagtccaagaaccagacttccctgagactgacctctgtgaccgccgcagacacggccgtgtatttctgtgtcggtacgagtgtccatgacagtcacaaacaactggtctcctggggccagggaaccctggtcaccgtctcctcagcctccaccaagggcccatcggtcttccccctggcaccctcctccaagagcacctctggggcacagcggccctgggctgcctggtcaaggactacttccacgcgtatgt

SEQ ID NO: 453681 - DNA, 396 bp, Homo sapiens; identical to SEQ ID NO: 444469
  misc_feature: HEFZJCU01A813W.47.46.E02.1.454.heavy.3.raw

SEQ ID NO: 453682 - DNA, 484 bp, Homo sapiens; identical to SEQ ID NO: 445311
  misc_feature: HEFZJCU01ELPAN.11.23.C01.1.454.heavy.3.raw

SEQ ID NO: 453683 - DNA, 503 bp, Homo sapiens
  misc_feature: HEFZJCU01DL4J5.51.86.H09.1.454.heavy.3.raw
cgatcgtatacacgaccggtgctcgatttagtgctatagacttgggtttgggggggagacgagcccagcactggaagtcgccggtgtttccattcggtgatcatcaccgaacacagaggactcaccatggagtttggactgagctgggttttcctcgttgctcttttaagaggtgtccagtgtcaggtgcagctggtggactctgggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaataaaaattatgcagactccgtgaagggccgattcaccatctccagagacaattccaagaacactctatatttgcagatgaatagcctgagaattgaggacacggctgtgtattactgtgtgagagggtcggcatatttccggtttttggt

SEQ ID NO: 453684 - DNA, 437 bp, Homo sapiens; identical to SEQ ID NO: 444603
  misc_feature: HEFZJCU01AZF6X.3.21.B10.1.454.heavy.3.raw

SEQ ID NO: 453685 - DNA, 499 bp, Homo sapiens; identical to SEQ ID NO: 447792
  misc_feature: HEFZJCU01D1B38.17.10.A10.1.454.heavy.3.raw

SEQ ID NO: 453686 - DNA, 532 bp, Homo sapiens
  misc_feature: HEFZJCU01BABW8.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactactgggccagggaaccctggtcaccgtctcctcagcctccaccaggcc

SEQ ID NO: 453687 - DNA, 510 bp, Homo sapiens
  misc_feature: HEFZJCU01BSDGL.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcacgtctccgcagcctccaccaggccc

SEQ ID NO: 453688 - DNA, 529 bp, Homo sapiens
  misc_feature: HEFZJCU01DRY2E.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccaggggggacctttggggtttcgacccctggggccagggaaccctggtcaccgtctcctcagcctccaccaagggcccatcggtcttccccctggcaccctcctccaagagcacctctcggggggcacgagcc

SEQ ID NO: 453689 - DNA, 516 bp, Homo sapiens
  misc_feature: HEFZJCU01C2NAS.48.73.G07.1.454.heavy.3.raw
agtatacatacacgaccggtgctcgatttagctctacgctcagggcacgaccggtgctcgatttagtcacgcgagaaagggaaaggggctgggagaggagccccagccttggaattcccaagtgttttcattcagtgatcaggactgaacacagaggactcaccatggagtttgggctgagctggattttccttgctgctattttaaaaggtgtccagtgtgaggtgcagctggtgcagtccggggggggcctggtaccgcctggggggtcccttagactctcctgtgcagcctctggattcatcttcagtaatgtctggatgacctggttccgccaggctccgagggaaggggctggagtgggttggccgtgttaaaccaagctgagggtgggacaatagactacgctgcacccgtgacaggcagattcgccatctcaagagatgattcagaaggcacgctgtatctgcaaatgaacagcctgaaagccgaaggacacagccgtagtattattcg

SEQ ID NO: 453690 - DNA, 511 bp, Homo sapiens; identical to SEQ ID NO: 445840
  misc_feature: HEFZJCU01BGL14.11.13.B02.1.454.heavy.3.raw

SEQ ID NO: 453691 - DNA, 484 bp, Homo sapiens; identical to SEQ ID NO: 445876
  misc_feature: HEFZJCU01EF5E7.8.39.D06.1.454.heavy.3.raw

SEQ ID NO: 453692 - DNA, 421 bp, Homo sapiens
  misc_feature: HEFZJCU01CJN9L.16.78.H01.1.454.heavy.3.raw
tgtactactccacgaccggtgctcgatttagtgtgagtagtttgggtttggggcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcggggactacctcgacccctggggccagggaatactggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 453693 - DNA, 386 bp, Homo sapiens; identical to SEQ ID NO: 446054
  misc_feature: HEFZJCU01C0F5A.18.60.F05.1.454.heavy.3.raw

SEQ ID NO: 453694 - DNA, 500 bp, Homo sapiens; identical to SEQ ID NO: 446033
  misc_feature: HEFZJCU01AFEE2.11.27.C05.1.454.heavy.3.raw

SEQ ID NO: 453695 - DNA, 509 bp, Homo sapiens
  misc_feature: HEFZJCU01C7UJ6.5.41.D08.1.454.heavy.3.raw
atcagacacgcacgaccggtgctcgatttagtcacgcgagaaagggaaagggatgatccgccccagcagctacaggtgtccagtcccaggtgcagctggtgcagtctggggctgccgtgaagaagcctgggtcctcggtgacactctcctgcaaggcgtctggagccaccttcaccaactatgctttcaactgggtgcgacgggcccctgggcagggacttgagtggctggggcggatcatccctaccgttgatgtggcaaactatgcacagaagttccagggcagagtcacaattaccgcggacaagtccgcgagcacagcctacatggagctgaacaacctgagatctgaagacacggccgtctattactgtacgacctgcgctacggtgactaccgctctgcttcgggacctatatggtctggacgtctgggggccaagggagcactgtcaccgtctcctcagcctccaccaagggcccatcggtcttcccctcggccaccctcct

SEQ ID NO: 453696 - DNA, 519 bp, Homo sapiens; identical to SEQ ID NO: 448643
  misc_feature: HEFZJCU01DSL90.9.34.D01.1.454.heavy.3.raw

SEQ ID NO: 453697 - DNA, 488 bp, Homo sapiens
  misc_feature: HEFZJCU01BRXQI.48.20.B09.1.454.heavy.3.raw
agtatacatacacgaccggtgctcgatttagtgtagtgtgaagggggggcctggtaccgcctggggggtcccttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttcccctggcgcctgctccaggagcacctccgagagcacagcggccctgggctgcctggtcaaggactacttcctatgtatact

SEQ ID NO: 453698 - DNA, 514 bp, Homo sapiens
  misc_feature: HEFZJCU01EGBQI.4.57.F02.1.454.heavy.3.raw
  modified_base (493)..(493): a, c, t, g, unknown or other
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcncctctggggcacagcggcccg

SEQ ID NO: 453699 - DNA, 535 bp, Homo sapiens; identical to SEQ ID NO: 448705
  misc_feature: HEFZJCU01BGAF7.17.28.C06.1.454.heavy.3.raw

SEQ ID NO: 453700 - DNA, 525 bp, Homo sapiens
  misc_feature: HEFZJCU01DD1UV.47.6.A06.1.454.heavy.3.raw
  modified_base (511)..(511): a, c, t, g, unknown or other
agctcacgtacacgaccggtgctcgatttagatctactgacagcacacgaaggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaaggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgattttggagtggccttgataactggggccaggggatcctggtcaccgtctcctcncgcctccaccaacc

SEQ ID NO: 453701 - DNA, 506 bp, Homo sapiens
  misc_feature: HEFZJCU01ER1EY.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcacccctctccagagacacttccaacaacatcttgtatcttcacatgcacaatctgagagtcgacgacacggccacctattattgtgcgcgacatgactacgctcaattctggggccagggacg

SEQ ID NO: 453702 - DNA, 506 bp, Homo sapiens; identical to SEQ ID NO: 446520
  misc_feature: HEFZJCU01BJPQG.10.38.D05.1.454.heavy.3.raw

SEQ ID NO: 453703 - DNA, 531 bp, Homo sapiens
  misc_feature: HEFZJCU01EV7RV.48.86.H09.1.454.heavy.3.raw
agtatacatacacgaccggtgctcgatttagtgctatagacttgggtttggggggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagcccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtcgtggcagtggctggtacgtggctctcagtggttcgacccctgggggccaggggactaccgtgggtccaccggttctccctcagcctttcccaccgaac

SEQ ID NO: 453704 - DNA, 517 bp, Homo sapiens
  misc_feature: HEFZJCU01CZVNZ.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactgggccagggaaccctggtcaccgtctcctcagcctccaccaagggcccatcggtcttcccctggcaccctcctccaagagcacctctgggggcacagcggcctgggctgcctggtcaaggactacttcctagagacacg

SEQ ID NO: 453705 - DNA, 491 bp, Homo sapiens; identical to SEQ ID NO: 446104
  misc_feature: HEFZJCU01AUNOE.3.34.D01.1.454.heavy.3.raw

SEQ ID NO: 453706 - DNA, 479 bp, Homo sapiens
  misc_feature: HEFZJCU01DA2QI.11.63.F08.1.454.heavy.3.raw
  modified_base (473)..(473): a, c, t, g, unknown or other
cgagagataccacgaccggtgctcgatttagcgatcgtataagggggagcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttgagtggatgggacggatcaaccctaatagtggtggcacaaactatgcacagaagtttgagggcagggtcatcatgaccagggacacgtccatcagcacagcctacatggagctgagcaggctgacatctgacgacacggccgtgtattctgtgcgagagataaaggggattgngatacg

SEQ ID NO: 453707 - DNA, 379 bp, Homo sapiens; identical to SEQ ID NO: 444450
  misc_feature: HEFZJCU01BWUK8.47.77.G11.1.454.heavy.3.raw

SEQ ID NO: 453708 - DNA, 515 bp, Homo sapiens
  misc_feature: HEFZJCU01AH8F8.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccagttgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaactcctactacggtctggacgtctggggccaggggacc

SEQ ID NO: 453709 - DNA, 520 bp, Homo sapiens
  misc_feature: HEFZJCU01CM3Q9.48.34.D01.1.454.heavy.3.raw
agtatacatacacgaccggtgctcgatttagatcgtctgtgttgggtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagca

SEQ ID NO: 453710 - DNA, 506 bp, Homo sapiens
  misc_feature: HEFZJCU01BTX2C.48.59.F04.1.454.heavy.3.raw
agtatacatacacgaccggtgctcgatttagtacacacacttagggattggggcagggtgtacacctgtggttctcggggctgccctttggctttggagatggttttctcgatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccg

SEQ ID NO: 453711 - DNA, 497 bp, Homo sapiens
  misc_feature: HEFZJCU01CBJWS.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtatttactgtgcaaggaggtatagcagctactggtacgactactggggccagggaaccctggtcaccgtctcctcagcctccaccaagggcccatcggtcttccccctggcgccctgctccaggagcacctccgacgagcacagcggcccgtcgggctgcctggtcaaggactacttcccacgacgagta

SEQ ID NO: 453712 - DNA, 384 bp, Homo sapiens; identical to SEQ ID NO: 444492
  misc_feature: HEFZJCU01AV6AP.18.60.F05.1.454.heavy.3.raw

SEQ ID NO: 453713 - DNA, 469 bp, Homo sapiens
  misc_feature: HEFZJCU01A5SXP.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgcctgctccaggagcacctccgagagcacagcggccctgggctgcctggtcaaggactacttccctacagtgct

SEQ ID NO: 453714 - DNA, 506 bp, Homo sapiens; identical to SEQ ID NO: 446520
  misc_feature: HEFZJCU01C1SXK.10.38.D05.1.454.heavy.3.raw

SEQ ID NO: 453715 - DNA, 504 bp, Homo sapiens
  misc_feature: HEFZJCU01DJ2QB.40.10.A10.1.454.heavy.3.raw
tctagcgactcacgaccggtgctcgatttagcgtcgatctcaggggctcagagaggagccttagccctggactccaaggcctttccacttggtgatcagcactgagcacagaggactcaccatggaattggggctgagctgggttttccttgttgctattttagaaggtgtccagtgtgaggagcagctggtggagtctgggggaggcttggtccagcctggggggtccctgagactctcctgtgttgcctctgggttcacatttcgtaacaattggatgacctgggtccgccaggctccagggaaggggctggagtgggtggccaatataaaccgagatggaaataagatatactatgtggactctgttaagggccgattcaccatctccagagacaacgccaagagttcactgtttctgcaaatgagcagcctgagagccgaggacacggctctatattactgtacgagagatttcagcccctcccaaagtggaaattatta

SEQ ID NO: 453716 - DNA, 482 bp, Homo sapiens; identical to SEQ ID NO: 451792
  misc_feature: HEFZJCU01BBVTX.19.71.G05.1.454.heavy.3.raw

SEQ ID NO: 453717 - DNA, 508 bp, Homo sapiens; identical to SEQ ID NO: 445911
  misc_feature: HEFZJCU01B26VW.12.78.H01.1.454.heavy.3.raw

SEQ ID NO: 453718 - DNA, 519 bp, Homo sapiens; identical to SEQ ID NO: 449382
  misc_feature: HEFZJCU01BSUIA.16.10.A10.1.454.heavy.3.raw

SEQ ID NO: 453719 - DNA, 500 bp, Homo sapiens; identical to SEQ ID NO: 446033
  misc_feature: HEFZJCU01CJE78.11.27.C05.1.454.heavy.3.raw

SEQ ID NO: 453720 - DNA, 506 bp, Homo sapiens; identical to SEQ ID NO: 444696
  misc_feature: HEFZJCU01EUQTP.16.34.D01.1.454.heavy.3.raw

SEQ ID NO: 453721 - DNA, 506 bp, Homo sapiens
  misc_feature: HEFZJCU01CX6L3.2.53.E09.1.454.heavy.3.raw
acgctcgacacacgaccggtgctcgatttagagagagtgtgttgggtttgggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacaggcccctggacaagggcttgagtggatgggatggatcagtgcttacaacggtaacacaaactatgcacagaagttccagggcagagtcaccctgaccacagacacatccacgagcacagtcaacctggacctgaggagcctgacatctgacgacacggccgtgtattattgtgcgagaggacggagggggggagcgacgccttttgactactggggccagggaaccctggtcaccgtctcctcagcctccaccaaggg

SEQ ID NO: 453722 - DNA, 481 bp, Homo sapiens; identical to SEQ ID NO: 445006
  misc_feature: HEFZJCU01DXGCM.7.10.A10.1.454.heavy.3.raw

SEQ ID NO: 453723 - DNA, 504 bp, Homo sapiens
  misc_feature: HEFZJCU01B0WWI.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcaggcggcctttgacttctc

SEQ ID NO: 453724 - DNA, 520 bp, Homo sapiens
  misc_feature: HEFZJCU01ECTVS.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggcccagtccggtcttccccctggccgccctgcctccaggagcacccg

SEQ ID NO: 453725 - DNA, 502 bp, Homo sapiens; identical to SEQ ID NO: 450016
  misc_feature: HEFZJCU01EL1NO.17.10.A10.1.454.heavy.3.raw

SEQ ID NO: 453726 - DNA, 527 bp, Homo sapiens
  misc_feature: HEFZJCU01EKQPF.13.39.D06.1.454.heavy.3.raw
tcacgtactacacgaccggtgctcgatttagtgacatctcgcagttctttggggagctctgggagtggagccccagccttgggattcccaagtgtttgttttccgtgatcaggactgaacacacaggactcaccatggagttggggctgagctggattttccttcttgctatgttagaaggtgtccagtgtgaggtgcacctggtggagtctgggggaggcttggtacagcctggggggtccctgagactctcctgtgcagcctctggattcaccttcagtacctacgacatgcactgggtccgccaacctctaggaaaaggtccggagtgggtctcagggattggcagtgttggtgacacattctattcagactccgtgaagggccgattcaccatctccagagaaaatgccaacaactccttccatcttcaaatgaacagcctgagagacggggacacggctgtgtattactgtgcaagaggggcaatttcttattactacttcgacgtctggggcaaagggacc

SEQ ID NO: 453727 - DNA, 511 bp, Homo sapiens; identical to SEQ ID NO: 446224
  misc_feature: HEFZJCU01ESSR7.7.28.C06.1.454.heavy.3.raw

SEQ ID NO: 453728 - DNA, 513 bp, Homo sapiens
  misc_feature: HEFZJCU01DDO1Q.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaaggggccggagtgggtgtcagtcattagtagtagtggtgatagaatttaccacacagactccgtgaagggccgcttcaccatctctagagacaattcccagaacacactgtatctgcaaatgactaggctgagagccgacgacacggccatttattactgcgcgaaggatagtacgggtcgacaacggtggctacgcgtttcag

SEQ ID NO: 453729 - DNA, 427 bp, Homo sapiens; identical to SEQ ID NO: 444708
  misc_feature: HEFZJCU01DDBIY.9.34.D01.1.454.heavy.3.raw

SEQ ID NO: 453730 - DNA, 501 bp, Homo sapiens
  misc_feature: HEFZJCU01BXNCN.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagcgtggttttccgtcgttaggcgtctttaagtagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttaattactgtgggagaaatcctagtggca

SEQ ID NO: 453731 - DNA, 509 bp, Homo sapiens
  misc_feature: HEFZJCU01ANZTQ.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcacctcctccaagagcacctctgggggcacagcggccctgggctgcctggtccaaggactacttcctacgtcgtat

SEQ ID NO: 453732 - DNA, 506 bp, Homo sapiens; identical to SEQ ID NO: 444696
  misc_feature: HEFZJCU01EA92O.16.34.D01.1.454.heavy.3.raw

SEQ ID NO: 453733 - DNA, 526 bp, Homo sapiens
  misc_feature: HEFZJCU01A9F9C.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactactccacg

SEQ ID NO: 453734 - DNA, 487 bp, Homo sapiens; identical to SEQ ID NO: 450070
  misc_feature: HEFZJCU01BIU73.47.55.E11.1.454.heavy.3.raw

SEQ ID NO: 453735 - DNA, 529 bp, Homo sapiens
  misc_feature: HEFZJCU01D7DOM.40.56.F01.1.454.heavy.3.raw
tctagcgactcacgaccggtgctcgatttagcagacgtctgaacacacaaagggggtgctttctgagagtcatggacctcctgcacaaaaacatgaaacacctgtggttcttcctcctcctggtggcagctcccagatgggtcctgtcccagccgcagctacagcagtggggcgcgggactgttgaagccttcggagaccctgtccctcacctgcgctgtcaatggtgagtcctttggtggttatcactggagctggatccgccagtctccccggaggggcctggagtggattggcgaaatcaatcatcgtgaaatcaccaactacaacccgtccctcaagagtcgaatcagtatttctgtagacacgtccaagaagcaattctccctgatgatgagttctctgaccgccgcggacacggctgtgtatttctgtgcgagccaacatgaaggcagtttgggggagttagtggtaccccgttttgagttagtttgggggccgaggggagtccgtggttcaccgtcctcctc

SEQ ID NO: 453736 - DNA, 492 bp, Homo sapiens; identical to SEQ ID NO: 447948
  misc_feature: HEFZJCU01CKTD7.10.29.C07.1.454.heavy.3.raw

SEQ ID NO: 453737 - DNA, 518 bp, Homo sapiens
  misc_feature: HEFZJCU01ENY0K.19.26.C04.1.454.heavy.3.raw
  modified_base (512)..(512): a, c, t, g, unknown or other
tactctcgtgcacgaccggtgctcgatttagtctagcgactttgggtttgggctgagcgtgggttttctcgttagctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggttttggacgttctgggggccaaggggaccacggtcgatcgtctcccagcctccaccaagggcccatcggtcttcccctgcgccctgctccaggngcaccg

SEQ ID NO: 453738 - DNA, 524 bp, Homo sapiens; identical to SEQ ID NO: 445902
  misc_feature: HEFZJCU01ANUO6.9.78.H01.1.454.heavy.3.raw

SEQ ID NO: 453739 - DNA, 499 bp, Homo sapiens; identical to SEQ ID NO: 447326
  misc_feature: HEFZJCU01AEU1H.40.81.H04.1.454.heavy.3.raw

SEQ ID NO: 453740 - DNA, 483 bp, Homo sapiens; identical to SEQ ID NO: 444639
  misc_feature: HEFZJCU01BCX2H.11.23.C01.1.454.heavy.3.raw

SEQ ID NO: 453741 - DNA, 483 bp, Homo sapiens; identical to SEQ ID NO: 444924
  misc_feature: HEFZJCU01DWCMF.10.35.D02.1.454.heavy.3.raw

SEQ ID NO: 453742 - DNA, 542 bp, Homo sapiens
  misc_feature: HEFZJCU01CIDAY.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacggtatggacctctggggccaagggaccg

SEQ ID NO: 453743 - DNA, 490 bp, Homo sapiens
  misc_feature: HEFZJCU01DU3EF.40.33.C11.1.454.heavy.3.raw
tctagcgactcacgaccggtgctcgatttagagtgagctcgttgggtttggggaggcttagttcagcctggggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatctccagagacaacgccaagaacacagtgtctctgcaaatggacagtctgagagccgaggacacgggtgtctattattgtacaaaagtggggactaatgaatatggtgtggacgtctggggccaagggaccacggtcgtcgcctcttatgcctccaccaagggcccatcggtcttcccctggcgccctgctccaggagcacctccgagagcacagcggccctgggctgcctggtcaaggactacttccagtcgctaga

SEQ ID NO: 453744 - DNA, 523 bp, Homo sapiens
  misc_feature: HEFZJCU01EUAMU.48.5.A05.1.454.heavy.3.raw
agtatacatacacgaccggtgctcgatttagatagatagacaggggagagaggagcccagccctgggattttcaagtgttttcatttggtgatcaggactgaacagagagaactcaccatggagtttgggttgagctggctttttcttgtggctattttaaaaggtgtccagtgtgaggtgcagctgttggagtctgggggaggcttggtacagccgggggggtccctgagactctcctgtgcaacctctggattcacctttaggggctatgccatgaactgggtccgccaggttcctgggaaggggctggagtgggtctcatctattagtgagactggtgatactacagactacgcagactccgtggaggggccggttcaccgtctccagagacattccaagaacacgctattctgacaatgaacagcctgagagtcgacgacacggccgtatactactgtgcgagacagatgctgccgcctgttccgtggggccagggaccctggtcaccgtctcctcacg

SEQ ID NO: 453745 - DNA, 506 bp, Homo sapiens
  misc_feature: HEFZJCU01CZ0S6.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctcaaatgaacagcctgagaggcgaggacacggcagtgtattactgtgcgagagatcgacatgactacgggaaagcttttgatctctggggccaagggacactggtcaccgtctcttcagcctccaccaagggcccatcgtcttcccctggcgccctgctccaggacg

SEQ ID NO: 453746 - DNA, 528 bp, Homo sapiens
  misc_feature: HEFZJCU01A586X.12.38.D05.1.454.heavy.3.raw
atacgacgtacacgaccggtgctcgatttagtatctgatagttgggttttccttgttgcttttttacaaggtgtccagtgtgaggtgcaactggtggagtctggggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttccccctggccgccctgctccaggagcacctccgagagcacagcggccctcgggctcg

SEQ ID NO: 453747 - DNA, 470 bp, Homo sapiens; identical to SEQ ID NO: 444866
  misc_feature: HEFZJCU01DP6KL.4.36.D03.1.454.heavy.3.raw

SEQ ID NO: 453748 - DNA, 429 bp, Homo sapiens
  misc_feature: HEFZJCU01BHV4W.40.34.D01.1.454.heavy.3.raw
tctagcgactcacgaccggtgctcgatttagatcgtctgtgttgggtttgggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactgggccagggaaccctggtcaccgtctcttcagcttccaccaagggcccatcggtcttccccctggcgccctgctccaggagcacctctgggggcacagcggccctgggctgcctggtcaaggactacttccagtcgctaga

SEQ ID NO: 453749 - DNA, 509 bp, Homo sapiens; identical to SEQ ID NO: 445824
  misc_feature: HEFZJCU01CGZI9.9.14.B03.1.454.heavy.3.raw

SEQ ID NO: 453750 - DNA, 509 bp, Homo sapiens; identical to SEQ ID NO: 450407
  misc_feature: HEFZJCU01DDAFK.13.39.D06.1.454.heavy.3.raw

SEQ ID NO: 453751 - DNA, 517 bp, Homo sapiens
  misc_feature: HEFZJCU01EB4K2.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtcgtgggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatacgtggggccaggggaacccctgggtcgcccg

SEQ ID NO: 453752 - DNA, 483 bp, Homo sapiens
  misc_feature: HEFZJCU01CLD22.19.53.E09.1.454.heavy.3.raw
tactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagc

SEQ ID NO: 453753 - DNA, 521 bp, Homo sapiens
  misc_feature: HEFZJCU01D5D64.10.87.H10.1.454.heavy.3.raw
catagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagcgtggttttccgtggtaggctctttaggaggtgcccagtgtcaagtgcagctggtggagtctgggggaggcgtggtccagcctggggggtccctgagactctcctgtgcagcctctggattcgacttcgaaatgtctggcatgcactgggtccgccaggctccaacgaaggggctggagtgggtggcagttctttcatttgatgaaaaagggatattatgcgacctccgtgaagggccgattcagcatctccagagacatttccaaggccacggtgtatctgcaaatgaccagcctgagaagtggaggacacggctatgtactattgtgcgaaggaccttccacctagaaactaatagtggggggctttgaacacgtc

SEQ ID NO: 453754 - DNA, 510 bp, Homo sapiens
  misc_feature: HEFZJCU01C68IG.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactgggccagggcaccctggtcaccgtctcctcagcttccacaagggcccatcggtcttcccctggcgccctgctccaggagcacctcgtgggggcacagcggccctgggctgcctggtcaggactacttcccatac

SEQ ID NO: 453755 - DNA, 519 bp, Homo sapiens
  misc_feature: HEFZJCU01CX3PZ.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctggggccaggggaccaac

SEQ ID NO: 453756 - DNA, 510 bp, Homo sapiens
  misc_feature: HEFZJCU01BDZNC.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaaccct

SEQ ID NO: 453757 - DNA, 517 bp, Homo sapiens
  misc_feature: HEFZJCU01DSHGP.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggcgccctgctccaggagcacctccgagagcacagccggccc

SEQ ID NO: 453758 - DNA, 502 bp, Homo sapiens; identical to SEQ ID NO: 445414
  misc_feature: HEFZJCU01CS5G9.17.25.C03.1.454.heavy.3.raw

SEQ ID NO: 453759 - DNA, 488 bp, Homo sapiens
  misc_feature: HEFZJCU01CC7UE.13.39.D06.1.454.heavy.3.raw
tcacgtactacacgaccggtgctcgatttagtgacatctcgcagttctttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggtccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaaatta

SEQ ID NO: 453760 - DNA, 506 bp, Homo sapiens
  misc_feature: HEFZJCU01DX51I.48.75.G09.1.454.heavy.3.raw
agtatacatacacgaccggtgctcgatttagtatagacatcagggggactcctgtgccccaccatggacacactttgctccacgctcctgctgctgaccatcccttcatgggtcttgtcccagatcaccttgaaggagtctggtcctacgctggtgaaacccacacagaccctcacactgacctgcaccttctcgggcttctcactcactcgtagtggggaggctgtggcctggattcgtcagcccccagggaaggccctggagtggcttgctctcatttactgggatactgatgaccgctacactccagctctgaaaaacaggctcaccatcgccatggacacctccaaaaacaggtggtccttaaaatgaccaacatggacccaatggacagcgcgacatattactgtgcacacattgattgtggtcccaccaggtgtcccgggccctttgatatctggggccgggggacattcgtcaccgtctctgcagcctccaccaggccc

SEQ ID NO: 453761 - DNA, 511 bp, Homo sapiens
  misc_feature: HEFZJCU01EMNEY.53.39.D06.1.454.heavy.3.raw
cgcgtatacacacgaccggtgctcgatttagtgacatctcgcagttctttggggggatctcatgtgcaagaaaatgaagcacctgtggttcttcctcctgctggtggcggctcccagatgggtcctgtcccagctgcagctgcaggagtcgggcccaggactggtgaagccctcggagaccctgtccctcacctgcactgtctctggtgcctccatcagcacaagtaatcactactggggctggctccgccagcccccagggaagggctggagtggattgggagtatgtattatggtggggccacctactacaacccgtccctcaagagtcaagtcaccatatccgtagacacgtccagcaaccagttctccctgaggctgtcctctgtgaccgccgcagacacggctgtctattactgtgcgagacatgtggggccatgggagtggtcgtacaactggttcgacccctggggccagggaaccctggtcaccgtctcctcagcctccaccg

SEQ ID NO: 453762 - DNA, 510 bp, Homo sapiens
  misc_feature: HEFZJCU01B70JE.2.53.E09.1.454.heavy.3.raw
acgctcgacacacgaccggtgctcgatttagagagagtgtgttgggtttggggcccctagatcacagctcctcaccatggactggacctggagcatccttttcttggtggcagcagcaacaggtgcccacgcccaggttcaattggtgcagtctggaactgaggtgaagaagcctggggcctcagtgaaggtctcctgcaaggcttctggttacatctttagcgactatggtatcagctgggtgcgacaggcccctggacaagggcttgagtggatgggatggatcagtgcttacaacggtaacacaaactatgcacagaagttccagggcagagtcaccctgaccacagacacatccacgagcacagtcaacctggacctgaggagcctgacatctgacgacacggccgtgtattattgtgcgagaggacggagggggggagcgacggccttttgactactggggccagggaaccctggtcaccgtctcctcagcctccaccaaggccc

SEQ ID NO: 453763 - DNA, 516 bp, Homo sapiens
  misc_feature: HEFZJCU01BCOQJ.14.14.B03.1.454.heavy.3.raw
cgtctagtaccacgaccggtgctcgatttagtgtgagtagtttgggctgagctgggtcttccttgttgctattataaaggtgtccagtgtcaagtgcagttggtggagtctgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcatgttttagaagttggggcttttgacactggggccagggaaccctggtcaccgtctcttcagcctccaccaagggcccatcggtcttccccctggcaccctcctccaagagcacctctc

SEQ ID NO: 453764 - DNA, 506 bp, Homo sapiens; identical to SEQ ID NO: 444696
  misc_feature: HEFZJCU01CSXFT.16.34.D01.1.454.heavy.3.raw

SEQ ID NO: 453765 - DNA, 408 bp, Homo sapiens
  misc_feature: HEFZJCU01BGN3H.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactcccgggatcttgactactggggccaggggaccctggtcaccgtctcctcagcttccaccaagggcccatcggtcttccccctggcgccctgctccaggagcacctctgggggcacagcggccctgggctgcctggtcaaggactacttccgagtgcgtct

SEQ ID NO: 453766 - DNA, 537 bp, Homo sapiens
  misc_feature: HEFZJCU01ES8P4.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagcgtgcgtttctaggtggcttttaaagtgccagtgtgaggtgcaactgttggagtctgggggaggcttggtacaggccggggggtccctgagactctcctgtgcagcctctggattcaattttaacagctttgccatgggctgggtccgccaggctccagggaagggctggagtgggtctcgaatattaatgaaaggggtgataacacatactatgcggactctgtaaggggccggttcaccatctccagagacaattccaagaaaacactgtatctgcaattaaccagcctgagagtcgaggacacggcccttatttactgtgcgaaggatcgcccctataatggtggctggatcggggagtttggttcctggggccagggaaccctgggtcc

SEQ ID NO: 453767 - DNA, 515 bp, Homo sapiens
  misc_feature: HEFZJCU01DPHTR.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacgacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactgggccagggcaccctggtcaccgtctcctcagcttccaccaagggcccatcggtcttcccctggcgccctgctccaggagcacctctgggggcacgagcggcccgtgggctgcctggtcaaggactacttcccatacc

SEQ ID NO: 453768 - DNA, 427 bp, Homo sapiens
  misc_feature: HEFZJCU01DW4MC.9.34.D01.1.454.heavy.3.raw
tgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccccggcaccctcctccaagagcacctctgggggcacagcggccctgggctgcctggtcaaggactacttccagacgtatca

SEQ ID NO: 453769 - DNA, 508 bp, Homo sapiens; identical to SEQ ID NO: 445594
  misc_feature: HEFZJCU01BSZCG.17.25.C03.1.454.heavy.3.raw

SEQ ID NO: 453770 - DNA, 509 bp, Homo sapiens
  misc_feature: HEFZJCU01DLY3K.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactacttgactactggggccg

SEQ ID NO: 453771 - DNA, 515 bp, Homo sapiens
  misc_feature: HEFZJCU01CYIGS.3.82.H05.1.454.heavy.3.raw
  modified_base (294)..(294): a, c, t, g, unknown or other
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccnccaggctccaggggaagggctggagtgggtctcagttatttacaattctggtaccacatactactccgacccgtgaagggccgattaaccatctccagagacgattccgagaacacggtgtatcttcaaatgaacaacctgagagccgacgacacggccgtttattactgtgcgagagattcgagtggttcggggacctcacctggttctacttcgatctc

SEQ ID NO: 453772 - DNA, 481 bp, Homo sapiens
  misc_feature: HEFZJCU01CW0MC.16.10.A10.1.454.heavy.3.raw
tgtactactccacgaccggtgctcgatttagcgtcgatctcaggggtccctgagactctcctgtgcacgcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaacgggcccatcggtcttccccctggccaccctcctccaagagcacctcgtgggggcacagcggccctgggctgcctggtcaaggactacttccgagtagtaca

SEQ ID NO: 453773 - DNA, 489 bp, Homo sapiens
  misc_feature: HEFZJCU01EOCGK.10.85.H08.1.454.heavy.3.raw
catagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtccttcccctggcgccctgctccaggagcacctccgagagcacagccggccctgggctgcctggtcaaggactacttcccactactatg

SEQ ID NO: 453774 - DNA, 394 bp, Homo sapiens
  misc_feature: HEFZJCU01ESXVO.48.60.F05.1.454.heavy.3.raw
agtatacatacacgaccggtgctcgatttagtacgtcatcagggaaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctggggcacagcggccctgggctgcctggtcaaggactacttcctatgtatact

SEQ ID NO: 453775 - DNA, 505 bp, Homo sapiens; identical to SEQ ID NO: 445664
  misc_feature: HEFZJCU01BUS4R.12.33.C11.1.454.heavy.3.raw

SEQ ID NO: 453776 - DNA, 479 bp, Homo sapiens
  misc_feature: HEFZJCU01DMAXE.22.36.D03.1.454.heavy.3.raw
acatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctggtcaaggactacttccagacgtatca

SEQ ID NO: 453777 - DNA, 492 bp, Homo sapiens
  misc_feature: HEFZJCU01DKS97.49.53.E09.1.454.heavy.3.raw
agtcgagagacacgaccggtgctcgatttagagagagtgtgttgggtttggggggagacgagcccagcactggaagtcgccggtgtttccattcggtgatcatcactgaacacagaggactcaccatggagtttgggctgagcgtggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacg

SEQ ID NO: 453778 - DNA, 516 bp, Homo sapiens
  misc_feature: HEFZJCU01CCK8M.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctatttgactacgtggggccagggactctggtcaccgtctccgcagcctccaccaagggcccatcc

SEQ ID NO: 453779 - DNA, 521 bp, Homo sapiens
  misc_feature: HEFZJCU01BYFGJ.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggccaccctcctccaagagcacctctgggggcacagcggccctgggctgcctggtcaaggactacttccgagtagtacac

SEQ ID NO: 453780 - DNA, 481 bp, Homo sapiens
  misc_feature: HEFZJCU01DYCKE.22.36.D03.1.454.heavy.3.raw
acatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattcccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggcgccctgctccaggagcacctccgagagcacagcggccctgggctgcctggtcaaggactacttccagacgtatca

SEQ ID NO: 453781 - DNA, 515 bp, Homo sapiens
  misc_feature: HEFZJCU01B8Z1C.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtgggccggggaaccctggtcaccgtctcttcagcctccaccaagggcccatcggtcttcccctggccaccctcctccaagagcacctctgggggcac

SEQ ID NO: 453782 - DNA, 496 bp, Homo sapiens
  misc_feature: HEFZJCU01C1SCK.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaaggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctc

SEQ ID NO: 453783 - DNA, 508 bp, Homo sapiens
  misc_feature: HEFZJCU01EXGDR.49.20.B09.1.454.heavy.3.raw
agtcgagagacacgaccggtgctcgatttagtgtagtgtgaaggggacccaacaaccacatccctcctcagaagcccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatggatcaccgctggcaatggtgacacaaaatattcagagaagttccagggcagagtctccattaccagggacacagctgcgagtacagggtacatggaactgagtggcctgagatctgaggacacggctgtttattactgtgcgagagggaagtgggatattgtggcagctccaggtgcccaggccgggccctactttgactacgtc

SEQ ID NO: 453784 - DNA, 505 bp, Homo sapiens
  misc_feature: HEFZJCU01DYSGX.22.11.A11.1.454.heavy.3.raw
acatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaattcaagccgcggggtcacccaattagactactc

SEQ ID NO: 453785 - DNA, 524 bp, Homo sapiens
  misc_feature: HEFZJCU01BJJKM.14.55.E11.1.454.heavy.3.raw
cgtctagtaccacgaccggtgctcgatttagcactcgcacgttgggtttggggggaagaggaagactgacggtccccccaggagttcaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtggtgatccaggtatgattgtgtactactaccacggtctggacgtctggggccaagggaccacggtcaccgtctcctcagcctccaccaagggcccatcggtcttcccctggcaccctcctccaagagcacctctgggggcacagcgccctggctgcctggtcaaggactacttccg

SEQ ID NO: 453786 - DNA, 522 bp, Homo sapiens
  misc_feature: HEFZJCU01CEIL2.52.22.B11.1.454.heavy.3.raw
cgcagtacgacacgaccggtgctcgatttagacgacagctcagggggctctgggagaggagccccagccgtgagattcccaggagattccacttggtgatcagcactgaacacagacctccaaccatggagtttgggcttagctgcgttttccttgttgctattttaaaaggtgtccaatgtgaggtgcagctggttgagtctgggggaggcttggtacagccagggcggtccctgagactctcctgtgtaacctcaggattcatgtttggtgattatggaatgacctgggtccgccaggctccagggggaggcctggagtgggtagctttcgttagcagaaagactgaaggtgggacaacagaatacgccgcgtctgtagaaaggcagatttatcatctcaagagacgattccaaaggcatcgcctatctgcaaatgaacagcctagaaaaccgaggacacagccgtgttatttttgtactagagtcttcttgtatttactatgatactagtggttttaca

SEQ ID NO: 453787 - DNA, 489 bp, Homo sapiens
  misc_feature: HEFZJCU01CY8WP.47.55.E11.1.454.heavy.3.raw
agctcacgtacacgaccggtgctcgatttagcactcgcacgttgggtttgggaggcttagttcagcctggggagtccctgagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaacgccaagaactctctgtttctgcaaatggacagcctgagagtcgaagacacggctgtgtattactgtgtgtctctgacgcctcggccggaccttggcttctggggcctgggaaccctggtcaccgtctcctcggcctccaccaagggcccatcggtcttcccctggcgccctgctccaggagcacctccgagagcacagcggccctgggctgcctggtcaaggactacttcctacgtgagct

SEQ ID NO: 453788 - DNA, 509 bp, Homo sapiens
  misc_feature: HEFZJCU01DNS9B.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaaccccctccaccggcacagcctacatggagctgagcagtctgacacctgacgacacggccgtctattactgtgcgagagccgcgaatatgtggtgcaaagatggtcgttgttgttttggccggtgaactactggggccagggcaccctggtcaccgtctcctcagcttccaccaagggcccatcggtcttcccctggcgccctgctccaggagcacctctgggggcacagcggcctgggctgcctggtcaggactacttcccata

SEQ ID NO: 453789 - DNA, 496 bp, Homo sapiens
  misc_feature: HEFZJCU01AJDYS.9.78.H01.1.454.heavy.3.raw
tgatacgtctcacgaccggtgctcgatttagtgtgagtagtttgggtttggggggggtcctcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttatttagacatgaagagcctgcgcactgcggacacggccgtctatttctgtgtcaaagccagcgggcggatctacgatcctaacggctattactacggatttgacacctggggccagggaaccctggtcaccgtctcctcagcctccaccaagggcccatcggtcttccccctggcaccctcctccaagagcacctctggggcacagcggccctgggctgcctggtcaaggactacttccagacgtatca

SEQ ID NO: 453790 - DNA, 515 bp, Homo sapiens
  misc_feature: HEFZJCU01BLNLF.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaacccgtggtcgccgtctcctcagcctccaccaagggcccatcggtcttcccctggcaccctcctccaagagcacctctgggggcacagcggccctggctgcctggtcaaggctactccagacgtatca

SEQ ID NO: 453791 - DNA, 514 bp, Homo sapiens; identical to SEQ ID NO: 447990
  misc_feature: HEFZJCU01EYO6K.15.28.C06.1.454.heavy.3.raw

SEQ ID NO: 453792 - DNA, 519 bp, Homo sapiens; identical to SEQ ID NO: 452709
  misc_feature: HEFZJCU01BKTR1.3.82.H05.1.454.heavy.3.raw

SEQ ID NO: 453793 - DNA, 511 bp, Homo sapiens
  misc_feature: HEFZJCU01EUXQ1.52.83.H06.1.454.heavy.3.raw
cgcagtacgacacgaccggtgctcgatttagatcacgtgcgtcgcgggtctctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttatatcaaatgatggaagtaacaaatactatgtagactccgtgaagggccgattcaccatctccagagacaattccaagaatacgctgtatctgcacatgaacagcctgagagccgaagacacggggtgtttattactgtgcgaacttaattacggaggacaacggtaacccccgtccg

SEQ ID NO: 453794 - DNA, 540 bp, Homo sapiens
  misc_feature: HEFZJCU01CRF2S.48.40.D07.1.454.heavy.3.raw
agtatacatacacgaccggtgctcgatttagtgatagagcgtaacaacagaggggcccagacctgggattcccagctgtttctgcttgctgatcaggaccgcacacagagagctcaccatggagttggggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactgggtccgccaagctccagggaaggggctggagtgggtctcaaacgtgaacgttgatggcgggatcacaaaatacgcggactccgtgaaaggccgcttcaccgtctccagagacaacggcgagaatactctgtatttgcagatgagaaatctgagaggcgaggacaccgcgctttattattgtacaacgtcgttttacttttctaatggtggctcttacgaacgacatgactattggggtcggggaaccctggtctaccg

SEQ ID NO: 453795 - DNA, 507 bp, Homo sapiens; identical to SEQ ID NO: 446637
  misc_feature: HEFZJCU01DCQ4R.16.34.D01.1.454.heavy.3.raw

SEQ ID NO: 453796 - DNA, 510 bp, Homo sapiens
  misc_feature: HEFZJCU01D9R90.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggccac

SEQ ID NO: 453797 - DNA, 517 bp, Homo sapiens
  misc_feature: HEFZJCU01CGMY6.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccgaggcgggagttccaagtactcctttg

SEQ ID NO: 453798 - DNA, 424 bp, Homo sapiens
  misc_feature: HEFZJCU01BORRA.9.34.D01.1.454.heavy.3.raw
tgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggccggggaaccctggtcgccgtctcctcagcctccaccaagggcccatcggtcttcccctggcaccctcctccaagagcacctctgggggcacagcggccctgggctgcttggtcaaggactacttccaacgtatca

SEQ ID NO: 453799 - DNA, 525 bp, Homo sapiens
  misc_feature: HEFZJCU01AU69Z.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgccctgctccaggagcacctccgag

SEQ ID NO: 453800 - DNA, 520 bp, Homo sapiens
  misc_feature: HEFZJCU01CT8NV.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcgggggacctcaccctggttctacttcgatctctc

SEQ ID NO: 453801 - DNA, 496 bp, Homo sapiens
  misc_feature: HEFZJCU01AXN3V.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaaggactacttccgagtaataca

SEQ ID NO: 453802 - DNA, 506 bp, Homo sapiens; identical to SEQ ID NO: 444696
  misc_feature: HEFZJCU01EXGTS.16.34.D01.1.454.heavy.3.raw

SEQ ID NO: 453803 - DNA, 503 bp, Homo sapiens
  misc_feature: HEFZJCU01CLMQR.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttcccctgcgcctgctccaggagcacctctggggcacagcggccctgggctgcctggtcaaggactacttcctagtacgtga

SEQ ID NO: 453804 - DNA, 497 bp, Homo sapiens; identical to SEQ ID NO: 450948
  misc_feature: HEFZJCU01DVNQN.53.80.H03.1.454.heavy.3.raw

SEQ ID NO: 453805 - DNA, 496 bp, Homo sapiens
  misc_feature: HEFZJCU01BVQPY.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttccccctggcaccctcctccaagagcacctctgggggcacagcggccctggctgcctggtcaaggactacttccgagtagtaca

SEQ ID NO: 453806 - DNA, 506 bp, Homo sapiens
  misc_feature: HEFZJCU01AMX6U.48.59.F04.1.454.heavy.3.raw
agtatacatacacgaccggtgctcgatttagtacacacacttagggattggggatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgcagcccccagggaaggggctggagtggattgggagtatttaccacagtgggaggcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccaagggacaatggtcaccgtctcttcagcctccaccg

SEQ ID NO: 453807 - DNA, 513 bp, Homo sapiens
  misc_feature: HEFZJCU01BLYHI.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaatgaacaatctgagagtcgacgatacggctgtctatcattgtgttttcgatgccttcggtccgcgggtacttctggggccaggggtacccg

SEQ ID NO: 453808 - DNA, 491 bp, Homo sapiens; identical to SEQ ID NO: 445333
  misc_feature: HEFZJCU01D28PX.19.53.E09.1.454.heavy.3.raw

SEQ ID NO: 453809 - DNA, 396 bp, Homo sapiens; identical to SEQ ID NO: 444469
  misc_feature: HEFZJCU01D3YH7.47.46.E02.1.454.heavy.3.raw

SEQ ID NO: 453810 - DNA, 510 bp, Homo sapiens; identical to SEQ ID NO: 451344
  misc_feature: HEFZJCU01C9HRS.7.28.C06.1.454.heavy.3.raw

SEQ ID NO: 453811 - DNA, 506 bp, Homo sapiens
  misc_feature: HEFZJCU01EQS6I.48.38.D05.1.454.heavy.3.raw
  modified_base (394)..(394): a, c, t, g, unknown or other
agtatacatacacgaccggtgctcgatttagtatctgatagttgggtttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaanctgagctctgtgaccgccgcagacacggctgtctattactgtgcgaggccccgagcgcagtggctttttgatgcctttgatatgtggggccgaagggacaatggtcaccgtt

SEQ ID NO: 453812 - DNA, 538 bp, Homo sapiens
  misc_feature: HEFZJCU01CHUGX.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcactttatttatagtggtggtaccacatactacacagactccgtgaagggccgattcaccatctcagaagacaattccaggaacacattgtatcttcaaatgaataacctgagagccgaggacacggccatgtaattctgtgtggggcatttacttgacccctgggggccgggggaaccctgggtcctaccggtctccccacccctccaacccg

SEQ ID NO: 453813 - DNA, 512 bp, Homo sapiens
  misc_feature: HEFZJCU01BZ9NC.51.81.H04.1.454.heavy.3.raw
cgatcgtatacacgaccggtgctcgatttagtagtgtagattcgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcgggggcaggggtcatcatgaccggggacacgtccatcgccacaacttacatggaactgaccagtctgacatttgacgacacggccgtctattactgtgcgacagaagcggcgggacagaggttcgcttactggttcgaggctctccccacg

SEQ ID NO: 453814 - DNA, 526 bp, Homo sapiens
  misc_feature: HEFZJCU01D9F28.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggccggggaaccctggtcaccgtctccccaccctccaccaagggcccatcggtcttccccctcggcaccctctccaagagcacctctgggggcacagcggccctgggctgcctggtcaaggactacttcccatactcgta

SEQ ID NO: 453815 - DNA, 508 bp, Homo sapiens
  misc_feature: HEFZJCU01DIAN7.21.4.A04.1.454.heavy.3.raw
tcgtcgctcgcacgaccggtgctcgatttagagtagtgatcaggggtctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactgggtccgccaggctccagggaaggggctggagtgggtcggccgtattacaaggaaagctaacagttacagtacagaatacggcgcgtctgtgaaaggaaggttcaccatctcaagagatgattcaaagaactcactgtatctgcaaatgaacagcctgaaaaccgaggaacacggccgtgtattattggtggtagaacaaaagagtggatgtggtggtag

SEQ ID NO: 453816 - DNA, 507 bp, Homo sapiens
  misc_feature: HEFZJCU01CG88Q.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgtttctaggtggctaattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcaagttgtcacccatacactttgactactgggg

SEQ ID NO: 453817 - DNA, 510 bp, Homo sapiens
  misc_feature: HEFZJCU01EAC8Y.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggccatatattactgtgcgagagattgggccgacggaaccttgactactggggccagggaaccctggtcaccgt

SEQ ID NO: 453818 - DNA, 531 bp, Homo sapiens; identical to SEQ ID NO: 446857
  misc_feature: HEFZJCU01BGBD0.7.78.H01.1.454.heavy.3.raw

SEQ ID NO: 453819 - DNA, 511 bp, Homo sapiens; identical to SEQ ID NO: 445840
  misc_feature: HEFZJCU01CFWJL.11.13.B02.1.454.heavy.3.raw

SEQ ID NO: 453820 - DNA, 501 bp, Homo sapiens
  misc_feature: HEFZJCU01BHD83.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtctggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggact

SEQ ID NO: 453821 - DNA, 531 bp, Homo sapiens; identical to SEQ ID NO: 446857
  misc_feature: HEFZJCU01D6BSW.7.78.H01.1.454.heavy.3.raw

SEQ ID NO: 453822 - DNA, 377 bp, Homo sapiens
  misc_feature: HEFZJCU01EP90B.3.59.F04.1.454.heavy.3.raw
agacgcactccacgaccggtgctcgatttagtacacacacttagggactggagtggatagggaatacttattacgatgggcgcaccaactataacgtcttactcaggagtcgggtcaccatatcagtggacacgtccaacaacaacttctccctgaggctgacctctgtgaccgccgcagacacggccatttatcactgtgggagacaatgtagtgggggtgactgccccgaatactggggccagggaacccgggtcaccgtctcctcagcctccaccaagggcccatcggtcttccccctggcgccctgctccaggagcacctccgagagcacagcggccctgggctgcctggtcaaggacacttccgagtgcgtt

SEQ ID NO: 453823 - DNA, 503 bp, Homo sapiens; identical to SEQ ID NO: 445995
  misc_feature: HEFZJCU01BTJC3.17.25.C03.1.454.heavy.3.raw

SEQ ID NO: 453824 - DNA, 504 bp, Homo sapiens
  misc_feature: HEFZJCU01BEYFJ.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtggaaatgaacagtctgagagccgaggacacggctctctattactgtgcgagagccccgaaatagggtactacg

SEQ ID NO: 453825 - DNA, 501 bp, Homo sapiens
  misc_feature: HEFZJCU01AMLSP.49.27.C05.1.454.heavy.3.raw
agtcgagagacacgaccggtgctcgatttagacgcgatcgaagggtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctgggggccagggagccctggtcaccgtctcctcagcttccaccaggcccatcgtcttcccctggcg

SEQ ID NO: 453826 - DNA, 437 bp, Homo sapiens
  misc_feature: HEFZJCU01BHI1N.51.5.A05.1.454.heavy.3.raw
cgatcgtatacacgaccggtgctcgatttagatagatagacaggggccctcctggaagggacaggagcgcgcaagggtgagtcagaccctcctgccctcgatggcaggtggagaagattcagaaaggtctgagatccccgggacgcagcaccactgtcaatggggggccccagacgcctggaccagggcctgcgtgggaaaggcctctgggcacactcaggggctttttgtgaagggtccgcctactgtgtgactacggtaaatacgttaattcttctactacgatatggacgtctgggccaagggaccacggtcaccgtctcttcagcctccaccaagggcccatcggtcttccccctggcaccctcctcccaagagcacctctgggggcacagcggccctgggctgcctggtcaaggctacttcctcgtagcact

SEQ ID NO: 453827 - DNA, 516 bp, Homo sapiens
  misc_feature: HEFZJCU01DX0D4.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttccccctggcgccctgctccaggagcacctctgggggcacagcggcccg

SEQ ID NO: 453828 - DNA, 523 bp, Homo sapiens
  misc_feature: HEFZJCU01CLTQ8.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctcaagtactactttgacttctggggccagggaaccctggtcaccgtctcctcagcctccaccaaggcccatcggtcttcccctggcgccctgcctccaggagcacctccgag

SEQ ID NO: 453829 - DNA, 501 bp, Homo sapiens
  misc_feature: HEFZJCU01ENS7B.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgcttcggtcgcggacttctgggcagggaa

SEQ ID NO: 453830 - DNA, 384 bp, Homo sapiens; identical to SEQ ID NO: 445394
  misc_feature: HEFZJCU01CF84U.22.46.E02.1.454.heavy.3.raw

SEQ ID NO: 453831 - DNA, 492 bp, Homo sapiens; identical to SEQ ID NO: 444695
  misc_feature: HEFZJCU01DZ1RP.3.34.D01.1.454.heavy.3.raw

SEQ ID NO: 453832 - DNA, 491 bp, Homo sapiens
  misc_feature: HEFZJCU01DFHWP.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaagatttggggaatgaccactc

SEQ ID NO: 453833 - DNA, 431 bp, Homo sapiens; identical to SEQ ID NO: 453275
  misc_feature: HEFZJCU01A466I.11.39.D06.1.454.heavy.3.raw

SEQ ID NO: 453834 - DNA, 416 bp, Homo sapiens
  misc_feature: HEFZJCU01BW1YY.11.37.D04.1.454.heavy.3.raw
cgagagataccacgaccggtgctcgatttagtagcatactgttgggtgcgacaggcccctgggcaaggacttgagtggatgggacagatccacccttacactggcgacacaatttatgcacagaaatttcagggcagatttaccctgaccgaggacacggccatcaccacagtctacatggacctgaagagactgacaattaacgacacggccaaatattattgtgtcagagacaagactcaattttgtgttcgtggtcactgctggttcgacccctggggccagggaaccctgatcaccgtctcctctgcctccaccaagggcccatcggtcttcccctggcaccctcctccaagagcacctctggggcacagcggccctgggctgcctggtcaaggactactccgtatctctcg

SEQ ID NO: 453835 - DNA, 506 bp, Homo sapiens
  misc_feature: HEFZJCU01DT345.48.85.H08.1.454.heavy.3.raw
agtatacatacacgaccggtgctcgatttagtatcactcagtcgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctggagaccgtgacggacacgggccatttacactgtgcgcggggagtggacggagctcggtttcggagttatcatctactacttt

SEQ ID NO: 453836 - DNA, 396 bp, Homo sapiens
  misc_feature: HEFZJCU01EWSI4.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactattggggccagggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 453837 - DNA, 501 bp, Homo sapiens
  misc_feature: HEFZJCU01BOV9U.48.59.F04.1.454.heavy.3.raw
agtatacatacacgaccggtgctcgatttagtacacacacttagggattggggtctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccaagggacaatggtcaccgtct

SEQ ID NO: 453838 - DNA, 494 bp, Homo sapiens
  misc_feature: HEFZJCU01A454J.48.70.G04.1.454.heavy.3.raw
agtatacatacacgaccggtgctcgatttagtgtagtgtgaagggaaaggggggcctggtaccgcctggggggtcccttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttcccctggcgccctgctccaggagcacctccgagagcacagtggccctgggctgcctggtcaaggactacttcctatgtatact

SEQ ID NO: 453839 - DNA, 483 bp, Homo sapiens
  misc_feature: HEFZJCU01CWXTE.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttcccctggcgccctgctccaggagcaccctccgagagcacagcggccctgggctgcctggtcaaggactacttcctacgtgagct

SEQ ID NO: 453840 - DNA, 523 bp, Homo sapiens
  misc_feature: HEFZJCU01CZX20.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaagggctggagtggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagagtggggcccacgaacgttactacgctatggacgtcgtgggggccaagggacc

SEQ ID NO: 453841 - DNA, 489 bp, Homo sapiens
  misc_feature: HEFZJCU01A8L9W.49.17.B06.1.454.heavy.3.raw
  modified_base (480)..(480): a, c, t, g, unknown or other
agtcgagagacacgaccggtgctcgatttagtcgatagtgaagggggctctgggagacgagcccagcactggaagtcgccggtgtttccattcggtgatcatcactgaacacagaggactcaccatggagtttgggctgagctgggttttcctcgttgctcttttcagaggtgtccagtgttatgtgcagctggtggagtctgggggaggcgtggtccagcctgggaggtccctgagactcgcctgcaaaccgtccggattcaccttcagtaattatgcaatgcactgggtccgccagactccaggcaaggggctgcactgggtggcggccatatcatttgatggaagcaagaaatactatgcagactccgtgaggggccgattcaccatctccagagacagttccgatgacacagtgtatctgcaaatgaacagcctgagacctgaggacacggctctcttttactgtgcgccaggaancagtggctc

SEQ ID NO: 453842 - DNA, 375 bp, Homo sapiens; identical to SEQ ID NO: 448129
  misc_feature: HEFZJCU01D84ZN.49.45.E01.1.454.heavy.3.raw

SEQ ID NO: 453843 - DNA, 520 bp, Homo sapiens
  misc_feature: HEFZJCU01C8L5F.51.60.F05.1.454.heavy.3.raw
cgatcgtatacacgaccggtgctcgatttagtacgtcatcagggaaagggggcatcacataacaaccagattcctcctctaaagaagcccctgggagcacagttcatcaccatggactggacctggaagttcctctttgtggtggcagcagcaacaggtgtccagtcgcaggtccagctggtgcagtctgggactgaggtgaagaggcctgggtcctcggtgaaggtctcctgcaaggcatctaaaaacatcttaagaagttatgacatcgcctgggtgcgacaggcccctggacatgggcttgagtgggtgggcaggatcatccctatgtttggagtcgcaaactacgcacagaagttccggggcaaagtcacgttgaccgcggacacagtcacggacacagcctacatggaactcaacggcctcagatttgaggacacggccgtctattattgtgcgagagtgagaaattacggtggctactcccttgactactggggccagggaacctggtctaccg

SEQ ID NO: 453844 - DNA, 429 bp, Homo sapiens; identical to SEQ ID NO: 447944
  misc_feature: HEFZJCU01BI3E4.4.37.D04.1.454.heavy.3.raw

SEQ ID NO: 453845 - DNA, 477 bp, Homo sapiens; identical to SEQ ID NO: 444659
  misc_feature: HEFZJCU01BSQJC.16.10.A10.1.454.heavy.3.raw

SEQ ID NO: 453846 - DNA, 496 bp, Homo sapiens
  misc_feature: HEFZJCU01BCCBK.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaagggctggaatgggtggcagttatatcatatgatggaagctatcaatattacgcagattctgtgaagggccgactcaccatctccagagacaattccagaaacaaactgtatcttcaaataacagtctgagacttgaggacacggctgtctattactgtgcgagagactacggtgaccttttctggtatttcgatctctggggccgtggcaccctggtcactgtctcctcggcttccaccaagggcccatcggtcttcccctgcgcctgctcagagcacctctggggc

SEQ ID NO: 453847 - DNA, 483 bp, Homo sapiens; identical to SEQ ID NO: 444532
  misc_feature: HEFZJCU01A0W6E.47.59.F04.1.454.heavy.3.raw

SEQ ID NO: 453848 - DNA, 400 bp, Homo sapiens; identical to SEQ ID NO: 444452
  misc_feature: HEFZJCU01DVO4P.47.24.C02.1.454.heavy.3.raw

SEQ ID NO: 453849 - DNA, 509 bp, Homo sapiens; identical to SEQ ID NO: 445824
  misc_feature: HEFZJCU01DKJBR.9.14.B03.1.454.heavy.3.raw

SEQ ID NO: 453850 - DNA, 484 bp, Homo sapiens
  misc_feature: HEFZJCU01AQWB9.11.63.F08.1.454.heavy.3.raw
cgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggttcagttggtgcagtctggggctgaggtgaagaagcctggggcctcagtgaaggtctcctgcaaggcttctggatacagcttcaccggctactatatgcactgggtgcgacaggcccctggacaagggcttgagtggatgggacggatcaaccctaatagtggtggcacaaactatgcacagaagtttgagggcagggtcatcatgaccagggacacgtccatcagcacagcctacatggagctgagcaggctgacatctgacgacacggccgtgtattactgtgcgagagataaaggggattgtgatagtacctac

SEQ ID NO: 453851 - DNA, 509 bp, Homo sapiens
  misc_feature: HEFZJCU01ER640.2.33.C11.1.454.heavy.3.raw
acgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccatgctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtcctggggccagggtaaccccg

SEQ ID NO: 453852 - DNA, 524 bp, Homo sapiens
  misc_feature: HEFZJCU01ERVZZ.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctgggccggggaaccctggtcaccgtctccccaccctccaccaagggcccatcggtcttccccctggcaccctcctccaagagcacctctgggggcacagcgccctgggctgcctggtcaaggactacttcccatactcgta

SEQ ID NO: 453853 - DNA, 500 bp, Homo sapiens; identical to SEQ ID NO: 444864
  misc_feature: HEFZJCU01EQ1W2.9.30.C08.1.454.heavy.3.raw

SEQ ID NO: 453854 - DNA, 499 bp, Homo sapiens; identical to SEQ ID NO: 453163
  misc_feature: HEFZJCU01EYY78.22.5.A05.1.454.heavy.3.raw

SEQ ID NO: 453855 - DNA, 459 bp, Homo sapiens
  misc_feature: HEFZJCU01C0JC3.4.6.A06.1.454.heavy.3.raw
agcactgtagcacgaccggtgctcgatttagatctactgacagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcaccaccgcctacctgcagtggagcagcctgaaggcctcggacaccgccatgtattactgtgcgagcgcctatagatatagcagcacctggtacatgtggcgtggtgctttgatatctggggccaagggacaatggtcaccgtctcttcagcctccaccaagggcccatcggtcttcccctggcaccctcctccagagcacctctgggggcacagcggccctgggctgcctggtcaaggactacttccctacagtgct

SEQ ID NO: 453856 - DNA, 398 bp, Homo sapiens
  misc_feature: HEFZJCU01DCN6P.52.58.F03.1.454.heavy.3.raw
cgcagtacgacacgaccggtgctcgatttagtctgatcgagaagggaaaggggctggagtgggtggcctttatatcatatgatggaactcagaaaaatatgcagattccctgaggggccgactcaccatctccagagacaattccaagagcacactgtttctgcaaatgaacagcctgagacctgaggacacggctgtctactactgtgcgaggccgccaacaccctacggtgactacgactactacttcgcccactggggccaggggagtctggtcaccgtctcttcagcctccaccaagggcccatcggtcttccccctggcaccctcctccaagagcacctctggggcacagcggccctgggctgcctggtcaaggactacttcctatacgatcg

SEQ ID NO: 453857 - DNA, 505 bp, Homo sapiens; identical to SEQ ID NO: 445122
  misc_feature: HEFZJCU01C6AJT.49.31.C09.1.454.heavy.3.raw

SEQ ID NO: 453858 - DNA, 401 bp, Homo sapiens; identical to SEQ ID NO: 446139
  misc_feature: HEFZJCU01D7OM2.47.24.C02.1.454.heavy.3.raw

SEQ ID NO: 453859 - DNA, 500 bp, Homo sapiens
  misc_feature: HEFZJCU01EGOLH.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagagcacagcggccctgggctgcctggtcgaggactacttcctacgtcgtat

SEQ ID NO: 453860 - DNA, 480 bp, Homo sapiens
  misc_feature: HEFZJCU01A9PMZ.14.70.G04.1.454.heavy.3.raw
cgtctagtaccacgaccggtgctcgatttagtgtagtgtgaagggaaagggtccctaaaactctcctgtacaacctcaggattcgcctttcgcatctatgccatggcctgggtccgccagattccagggaaggggctggagtggatctcaactattagtggaagtgggagtggtgaatccacatattacgcaggctctgtgaagggccggttcaccatctccagagacaattcccaacaacacactttatctgcaaatgaacagcctgcgagccgaggacacggccctatattactgtgcaagagatcgaacaggcccgtgggagcccgttgactactggggccagggaaccctagtcatcgtctcctcagcctccaccaagggcccatcggtcttccccctggcaccctcctccaagagcacctctgggggcacagcggccctgggctgcctggtcaaggactacttccgtactagacg

SEQ ID NO: 453861 - DNA, 462 bp, Homo sapiens
  misc_feature: HEFZJCU01DHTYO.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaattggggccagggaaccctggtctccgtctcgtcagcctccaccaagggcccatcggtcttcccctggcgccctgctccaggagcacctccgagagcacagcggcctgggctgcctggtcaaggactacttcccacgagagta

SEQ ID NO: 453862 - DNA, 477 bp, Homo sapiens; identical to SEQ ID NO: 444659
  misc_feature: HEFZJCU01BZ08O.16.10.A10.1.454.heavy.3.raw

SEQ ID NO: 453863 - DNA, 504 bp, Homo sapiens; identical to SEQ ID NO: 449383
  misc_feature: HEFZJCU01B48QC.15.55.E11.1.454.heavy.3.raw

SEQ ID NO: 453864 - DNA, 533 bp, Homo sapiens
  misc_feature: HEFZJCU01DICN6.48.49.E05.1.454.heavy.3.raw
agtatacatacacgaccggtgctcgatttagagcgactagcaacacacaaagggggagagaagagcccagccctgggattttcaggtgttttcatttggtgatcaggactgaacagagagaactcaccatggagtttgggctgaggtggctttttcttgtggcgattttaagaggtgtccagtgtgaggtgaagttgttggagtctgggggaggcttggtaaagccggggggctccctgacactctcctgtgtaacctctggcttcgactttaagtcttatgccatgacctgggtccgccaggctccagggaaggggctggagtgggtctcaacaattagtgttagtggtgacgacagatactacgcagactccgtggagggccgcttcaccatctccagagacagccccaagaacacactgtctctggagatgatcaacctgagagccgacgacacggcagtgtattactgcgcgaaagaaatcaagtgggctcatctcgggcggccgacccactggggccaggggaacccc

SEQ ID NO: 453865 - DNA, 513 bp, Homo sapiens
  misc_feature: HEFZJCU01CPKI2.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagcgtgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtactattattgtgtcatagacctaggatacaacgcggtgtacctgt

SEQ ID NO: 453866 - DNA, 536 bp, Homo sapiens
  misc_feature: HEFZJCU01CS5XK.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatccctgaaagcgtcaactactactactacggtatggacctctggggaccg

SEQ ID NO: 453867 - DNA, 488 bp, Homo sapiens; identical to SEQ ID NO: 453605
  misc_feature: HEFZJCU01ETFUB.47.85.H08.1.454.heavy.3.raw

SEQ ID NO: 453868 - DNA, 397 bp, Homo sapiens
  misc_feature: HEFZJCU01D5X02.47.46.E02.1.454.heavy.3.raw
agctcacgtacacgaccggtgctcgatttagactcatctacagggaaagggggctggagtgggtctcaagtattgatgagtaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctagcgcacttctttgacttctggggccagggaatcctggtcaccgtctcctcagcctccaccaagggcccatcggtcttccccctggcaccctcctccaagagcgacctctggggcacagcggccctgggctgcctggtcaaggactacttcctacgtgagct

SEQ ID NO: 453869 - DNA, 386 bp, Homo sapiens; identical to SEQ ID NO: 446054
  misc_feature: HEFZJCU01EW0TH.18.60.F05.1.454.heavy.3.raw

SEQ ID NO: 453870 - DNA, 516 bp, Homo sapiens
  misc_feature: HEFZJCU01EHTHG.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttatgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggcctggctgcctggtcaaggattacttccagacgtatca

SEQ ID NO: 453871 - DNA, 536 bp, Homo sapiens; identical to SEQ ID NO: 450680
  misc_feature: HEFZJCU01ENMZT.18.59.F04.1.454.heavy.3.raw

SEQ ID NO: 453872 - DNA, 521 bp, Homo sapiens; identical to SEQ ID NO: 445317
  misc_feature: HEFZJCU01CVZ6I.12.40.D07.1.454.heavy.3.raw

SEQ ID NO: 453873 - DNA, 531 bp, Homo sapiens
  misc_feature: HEFZJCU01CVYQ9.12.12.B01.1.454.heavy.3.raw
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtggattgggagtatctattttagcgggagcacctaccagaacgcgtccctcaagagtcgaatcaccatgtcggtggacacatcgaagaaccagatctcccttaagttgaggtctgtgaccgcgctgacacggccgtctattactgtgcgagagtccgtgctggaagaacacttttttgactattggggccagggaatcctggtcaccgtcgcctcagcctccaccaagggcccatcggtcttcccccg

SEQ ID NO: 453874 - DNA, 502 bp, Homo sapiens; identical to SEQ ID NO: 450016
  misc_feature: HEFZJCU01AEFM2.17.10.A10.1.454.heavy.3.raw

SEQ ID NO: 453875 - DNA, 516 bp, Homo sapiens
  misc_feature: HEFZJCU01D52CC.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaaggcccatcc

SEQ ID NO: 453876 - DNA, 510 bp, Homo sapiens
  misc_feature: HEFZJCU01CH6XG.51.24.C02.1.454.heavy.3.raw
cgatcgtatacacgaccggtgctcgatttagtacagatcgttagggaaaggggggctctgggagaggagcccagcactagaagtcggcggtgtttccattcggtgatcagcactgaacacagacgactcaccatggactttgggctgagcgtggttttcctcgttaggctcttttaagaggtgtccactgtcaggtgcagttggtggagtctgggggaggcgcggtccagcctgggaggtccctgaggctctcctgcgcgtcctctggactccccttcagcacttatgacatgcactgggtccgccaggctccaggcaaggggctggagtgggtggcagtcatatcatatgatggaaaggataagtactatgcagactccatgaagggccgatccaccatctccagggacaattccaagaacacactgtatctgcaaataaacaacctgagagttgcggacacggctgtctattactgtgcggcaccgtgggggactacggtgacaacgt

SEQ ID NO: 453877 - DNA, 506 bp, Homo sapiens
  misc_feature: HEFZJCU01CTYL1.48.59.F04.1.454.heavy.3.raw
agtatacatacacgaccggtgctcgatttagtacacacacttagggattggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaatctccctgaagctgagctctgtgaccgccgcagacacggctgtctattactgtgcgaggccccgagcgcagtggcttttgatgcctttgatatgtgggccaagggacaatggtcacgtctcttcagcctcaccaaggccc

SEQ ID NO: 453878 - DNA, 494 bp, Homo sapiens; identical to SEQ ID NO: 445975
  misc_feature: HEFZJCU01B26D2.48.70.G04.1.454.heavy.3.raw

SEQ ID NO: 453879 - DNA, 400 bp, Homo sapiens; identical to SEQ ID NO: 444452
  misc_feature: HEFZJCU01AQ2TG.47.24.C02.1.454.heavy.3.raw

SEQ ID NO: 453880 - DNA, 518 bp, Homo sapiens; identical to SEQ ID NO: 444718
  misc_feature: HEFZJCU01EBNC5.9.34.D01.1.454.heavy.3.raw

SEQ ID NO: 453881 - DNA, 491 bp, Homo sapiens; identical to SEQ ID NO: 450202
  misc_feature: HEFZJCU01C4ULF.11.38.D05.1.454.heavy.3.raw

SEQ ID NO: 453882 - DNA, 520 bp, Homo sapiens
  misc_feature: HEFZJCU01EVCMN.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgtttattttaggaccagctgttaaaaactcctaactacggtctggacgtctggggccaggggaccaa

SEQ ID NO: 453883 - DNA, 493 bp, Homo sapiens
  misc_feature: HEFZJCU01CBM8O.12.55.E11.1.454.heavy.3.raw
  modified_base (481)..(481): a, c, t, g, unknown or other
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgacctttctggtatttcgatctctgggccgtggcaccctggtcactgtctcctcggcttccaccaaggccatcggtcttcccctgcgcctgctcagngcacctctgggc

SEQ ID NO: 453884 - DNA, 511 bp, Homo sapiens; identical to SEQ ID NO: 447235
  misc_feature: HEFZJCU01ENYM3.16.21.B10.1.454.heavy.3.raw

SEQ ID NO: 453885 - DNA, 518 bp, Homo sapiens; identical to SEQ ID NO: 444718
  misc_feature: HEFZJCU01CGSI5.9.34.D01.1.454.heavy.3.raw

SEQ ID NO: 453886 - DNA, 496 bp, Homo sapiens; identical to SEQ ID NO: 446592
  misc_feature: HEFZJCU01BB3L3.4.75.G09.1.454.heavy.3.raw

SEQ ID NO: 453887 - DNA, 489 bp, Homo sapiens; identical to SEQ ID NO: 444791
  misc_feature: HEFZJCU01BAUDN.47.85.H08.1.454.heavy.3.raw

SEQ ID NO: 453888 - DNA, 519 bp, Homo sapiens
  misc_feature: HEFZJCU01EOBDZ.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgacttacgtggggccagggaactctggtcaccgtctccgcagcctccaccaaggcccagtcc

SEQ ID NO: 453889 - DNA, 500 bp, Homo sapiens
  misc_feature: HEFZJCU01ELJLV.51.23.C01.1.454.heavy.3.raw
cgatcgtatacacgaccggtgctcgatttagtacacgtgattagggattggggatcacataacaaccagattcctcctctaaagaagcccctgggagcacagctcatcaccatggactggacctggaggttcctctttgtggtggcagcagttacaggtgtccattcccaggtccagctggtgcagtctggggctgaggtgaagatgcctgggtcctcggtgaaggtctcctgcaagtattctggaggcaccttcagcaactatggtatcagctgggtgcgacaggcccctggacaagggcttgagtggatggaagggtcacccctatatttgatgtagcagactctgcacagaagttccagggcagaataacaattacggcggacaaatccacgaccacagcctacatggagctgagcagcctgagatctgaggacacggccctttattactgtgcgagatttaccgtgggggtcacggcggatatatcgccatactta

SEQ ID NO: 453890 - DNA, 526 bp, Homo sapiens
  misc_feature: HEFZJCU01BEH8D.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttccgaccccgtggggccagggaaccctggtcaccgtctcctcagcctccaccaacgggcccatcggtcttccccctggccaccctcctccaagagcacctcgtgggggcacagcggcccgtgggctgcttggtcaaggactacttccgagtagtacac

SEQ ID NO: 453891 - DNA, 484 bp, Homo sapiens; identical to SEQ ID NO: 445311
  misc_feature: HEFZJCU01AU47X.11.23.C01.1.454.heavy.3.raw

SEQ ID NO: 453892 - DNA, 532 bp, Homo sapiens
  misc_feature: HEFZJCU01CZ30F.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtccaccgtctcctcagcctccaccaaggg

SEQ ID NO: 453893 - DNA, 384 bp, Homo sapiens; identical to SEQ ID NO: 444454
  misc_feature: HEFZJCU01ETBXE.11.61.F06.1.454.heavy.3.raw

SEQ ID NO: 453894 - DNA, 483 bp, Homo sapiens; identical to SEQ ID NO: 444639
  misc_feature: HEFZJCU01C9PQN.11.23.C01.1.454.heavy.3.raw

SEQ ID NO: 453895 - DNA, 487 bp, Homo sapiens; identical to SEQ ID NO: 444878
  misc_feature: HEFZJCU01AVGIF.47.85.H08.1.454.heavy.3.raw

SEQ ID NO: 453896 - DNA, 532 bp, Homo sapiens
  misc_feature: HEFZJCU01EVYEH.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttattcatatgatggaactactcaacactatccagactccggggaggccgattcaccgtctccagagacaattccaagaacagggtgtttctccaagtgattgatctgagaagtgaggacacggctgtttatactgtgcgcggtggctgaccgctcttgactacgtgggggccggggtagccccgggtcacttcgtcttccc

SEQ ID NO: 453897 - DNA, 483 bp, Homo sapiens; identical to SEQ ID NO: 444639
  misc_feature: HEFZJCU01EKN0K.11.23.C01.1.454.heavy.3.raw

SEQ ID NO: 453898 - DNA, 520 bp, Homo sapiens; identical to SEQ ID NO: 446725
  misc_feature: HEFZJCU01DTV5B.12.86.H09.1.454.heavy.3.raw

SEQ ID NO: 453899 - DNA, 497 bp, Homo sapiens
  misc_feature: HEFZJCU01ETBOV.12.87.H10.1.454.heavy.3.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagacccaaccccactgt

SEQ ID NO: 453900 - DNA, 481 bp, Homo sapiens; identical to SEQ ID NO: 445517
  misc_feature: HEFZJCU01DDJZ0.22.36.D03.1.454.heavy.3.raw

SEQ ID NO: 453901 - DNA, 523 bp, Homo sapiens
  misc_feature: HEFZJCU01EOH77.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggcctgtctattattgcgcgagagagacacacgaacctactggccaatactatgggggcttgttctggggccaggggaccctggtcatcgtctccccagcctccaccaagggcccatcggtcttccccctggcg

SEQ ID NO: 453902 - DNA, 467 bp, Homo sapiens; identical to SEQ ID NO: 445004
  misc_feature: HEFZJCU01AHRQE.16.78.H01.1.454.heavy.3.raw

SEQ ID NO: 453903 - DNA, 492 bp, Homo sapiens
  misc_feature: HEFZJCU01D1F5A.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctgggccgtggcaccctgctgactgtctcctcagcctccaccaagggcccatcggtcttcccctggcgccctgctccaggagcacctccgagagcacagcgcctggctgcctggtcaaggactac

SEQ ID NO: 453904 - DNA, 504 bp, Homo sapiens
  misc_feature: HEFZJCU01BANC1.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatccggtcttcccctggccgccctgcctccaggacgcacctccgagagcacagcggccctgggctgcctggtcaaggactacttcctacgtcgtat

SEQ ID NO: 453905 - DNA, 501 bp, Homo sapiens; identical to SEQ ID NO: 447123
  misc_feature: HEFZJCU01DAQIM.3.20.B09.1.454.heavy.3.raw

SEQ ID NO: 453906 - DNA, 450 bp, Homo sapiens; identical to SEQ ID NO: 447544
  misc_feature: HEFZJCU01BH8XM.10.38.D05.1.454.heavy.3.raw

SEQ ID NO: 453907 - DNA, 518 bp, Homo sapiens; identical to SEQ ID NO: 444718
  misc_feature: HEFZJCU01C8DO5.9.34.D01.1.454.heavy.3.raw

SEQ ID NO: 453908 - DNA, 504 bp, Homo sapiens; identical to SEQ ID NO: 445399
  misc_feature: HEFZJCU01BNV38.17.74.G08.1.454.heavy.3.raw

SEQ ID NO: 453909 - DNA, 391 bp, Homo sapiens; identical to SEQ ID NO: 444994
  misc_feature: HEFZJCU01AD7IJ.40.58.F03.1.454.heavy.3.raw

SEQ ID NO: 453910 - DNA, 503 bp, Homo sapiens
  misc_feature: HEFZJCU01E2AGF.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaagggcccatcggtcttccccctggcgccctgctccaggagcacctccgagagcacagcggccctcgggctgcctggtcaaggacgtacttcctagtacgtga

SEQ ID NO: 453911 - DNA, 484 bp, Homo sapiens
  misc_feature: HEFZJCU01CBG7T.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggctctgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggagccaggggaccctggtcatcgtctcccagcctccaccaagggcccatcggtcttcccctggcgccctgctccaggagcacctccgagagcacagcggccctgggctgcctggtcaaggactacttcctacgtcgtat

SEQ ID NO: 453912 - DNA, 483 bp, Homo sapiens; identical to SEQ ID NO: 444639
  misc_feature: HEFZJCU01ESM1X.11.23.C01.1.454.heavy.3.raw

SEQ ID NO: 453913 - DNA, 509 bp, Homo sapiens
  misc_feature: HEFZJCU01EGC8S.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaaggggccggagtgggtgtcagtcattagtagtagtggtgatagaatttaccacacagactccgtgaagggccgcttcaccatctctagagacaattcccagaacacactgtatctgcaaatgactaggctgagagccgacgacacggccatttattactgcgcgaaggatatacgggtcgacaacggtggctacgcgttt

SEQ ID NO: 453914 - DNA, 518 bp, Homo sapiens
  misc_feature: HEFZJCU01EPW82.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaaccctggtcaccgtctcctcagcctccaccaagggcccatcggtcttcccctggcaccctcctccaagagcacctctgggggcacagcgccctgggctgcctggtcaaggactacttccgagtagtactac

SEQ ID NO: 453915 - DNA, 493 bp, Homo sapiens
  misc_feature: HEFZJCU01EPZQC.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatcctccagagacaacttcccagaacacggtctatctgcacctgaccagcctgagaactgacgacacgtctctctactactgtgcgagagagttgacgagt

SEQ ID NO: 453916 - DNA, 480 bp, Homo sapiens; identical to SEQ ID NO: 445011
  misc_feature: HEFZJCU01BPDQ6.22.36.D03.1.454.heavy.3.raw

SEQ ID NO: 453917 - DNA, 328 bp, Homo sapiens
  misc_feature: HEFZJCU01C6E7E.48.60.F05.1.454.heavy.3.raw
agtatacatacacgaccggtgctcgatttagtacgtcatcagggaaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctggggcacagcggccctgggctgactggtcaaggactacttcctatgtatact

SEQ ID NO: 453918 - DNA, 484 bp, Homo sapiens; identical to SEQ ID NO: 445311
  misc_feature: HEFZJCU01D53XH.11.23.C01.1.454.heavy.3.raw

SEQ ID NO: 453919 - DNA, 508 bp, Homo sapiens; identical to SEQ ID NO: 445594
  misc_feature: HEFZJCU01DZHRP.17.25.C03.1.454.heavy.3.raw

SEQ ID NO: 453920 - DNA, 513 bp, Homo sapiens
  misc_feature: HEFZJCU01D6B27.9.28.C06.1.454.heavy.3.raw
tgatacgtctcacgaccggtgctcgatttagagctcacgtattgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccactaatggagtgggtgtgggctggatccgtcatcccccaggaaaggccctggaatggcttgcattcgtttattggaatgatgataaacgctacagcccatctctgaggaccaggctcaccattaccaaggacacctccaaaaaccaggtggtccttacaatgaccaacatggaccctgtggacacagccacatattactgtgcacacagtgtcatgactgcggtgactgttctccctttggctactggggccagggggaccaaggtcaccgtctcctcagcctccaccaagggccc

SEQ ID NO: 453921 - DNA, 534 bp, Homo sapiens
  misc_feature: HEFZJCU01CQ2X9.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagaatgattcaaaaagcacgctgtatctgcaaatgaacagcctgagaaccgaggacacagccgtgtattactgtaccacatcccctgaaagcgtcaactactactactacggtatggacctcg

SEQ ID NO: 453922 - DNA, 521 bp, Homo sapiens
  misc_feature: HEFZJCU01C23YR.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctgggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccgaagggaccg

SEQ ID NO: 453923 - DNA, 496 bp, Homo sapiens
  misc_feature: HEFZJCU01D7JKF.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacgtggttggggctacgtggggccagggaaccctggtcaccgtctcctcagcctccaccg

SEQ ID NO: 453924 - DNA, 500 bp, Homo sapiens; identical to SEQ ID NO: 445720
  misc_feature: HEFZJCU01DNXRY.3.20.B09.1.454.heavy.3.raw

SEQ ID NO: 453925 - DNA, 491 bp, Homo sapiens
  misc_feature: HEFZJCU01BM07F.10.34.D01.1.454.heavy.3.raw
catagtagtgcacgaccggtgctcgatttagatcgtctgtgttgggtcccttagactctcctgtgcagcctctggattcactttcagtaacgcctggatgaactgggtccgccaggctccagggaaggggctggagtgggttggccatattaaaatcaaagctgatggtgggacaacagagcacgctgcacccgtgaaaggcagattcagcatctcaagagatgattcaaaaagtacgctgtatctgaacatgaacagcctgaaaacggaggacacagccgtgtattactgtgccactcaggaccgatattgttctgatggcgtatgctctaaggaggaccttgacttctggggccagggaaccctggtcaccgtctcctcagcctccaccaagggcccatcggtcttcccctggcgccctgctccaggagcacctccgagagcacagcggccctgggctgcctggtcaaggactacttcccactactatg

SEQ ID NO: 453926 - DNA, 507 bp, Homo sapiens
  misc_feature: HEFZJCU01CH94W.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggccctgggctgcctggcaaggactacttccgagtgcgtct

SEQ ID NO: 453927 - DNA, 517 bp, Homo sapiens
  misc_feature: HEFZJCU01BTJL0.2.85.H08.1.454.heavy.3.raw
acgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctggaggcaccttcaggacctatattatgacctgggtgcgacaggcccctggacaagggcttgagtggctgggggggatcatccctatgtttggtgaagcaaattacgcacagaagttccggggaagagtctcgattaccgcggacgaatccacgaacacagcctacatggaagtgaccagcctgagatctgaagacacggccgtgtattactgtgcgaagtcgtattactatgatactggtgattatttgaatttcgactcctaccactacggtatggacgtctggggccaggggaccacggtcaccgtctctt

SEQ ID NO: 453928 - DNA, 408 bp, Homo sapiens
  misc_feature: HEFZJCU01BCHBG.11.67.G01.1.454.heavy.3.raw
cgagagataccacgaccggtgctcgatttagagtatacatattgggtctcggctattaatggccacggtgacaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggtcttccccctggcaccctccctccaagagcacctctgggggcacagcggccctgggctgcctggtcaaggactacttccgtatctctcg

SEQ ID NO: 453929 - DNA, 537 bp, Homo sapiens
  misc_feature: HEFZJCU01D13V2.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatccctgaaacgcgtcaactactactactacggtatggacctctggggaccg

SEQ ID NO: 453930 - DNA, 517 bp, Homo sapiens
  misc_feature: HEFZJCU01BZUX5.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagccccaggaaaggccctggagtggcttgcactcatttattgggatgatgtgaagtactacagtccatatttcaagaggctcactatcaccaaggacacttccaaaaaccaagtggtcctgacaatgaccaacgtgaagcctgcggacacggccacatattattgtgcacaccgacgctataccgccagctgggaaatcgacaactggttcgacccctggggccagggaaccttgtcaccgtctcctcagcctccaccaagggcccacg

SEQ ID NO: 453931 - DNA, 511 bp, Homo sapiens
  misc_feature: HEFZJCU01CC386.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctctccaagagcacctctgggggcacagcggccctgggctgcctggtcaaggactacttccgagtgcgtct

SEQ ID NO: 453932 - DNA, 429 bp, Homo sapiens
  misc_feature: HEFZJCU01CPAYK.16.78.H01.1.454.heavy.3.raw
tgtactactccacgaccggtgctcgatttagtgtgagtagtttgggtttgggctcaactctcttgtccgccaggctccagggaaggggctggagtgggtctcatccattagtagtagtagtagttacatatattacgcagactcagtgaagggccgattcaccatctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 453933 - DNA, 510 bp, Homo sapiens
  misc_feature: HEFZJCU01CBMD5.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatgggtggatcaacgtacagactggtggcacagactatgcacaggggctccagggcagactcaccatgaccacagacacatcagcgaacacagtcaacatggagttgcggagcctgcgatctgacacgcggccgtatattactgtgcgagagtacgtagcggctcgtcctttgactctggggcctgggaactctggtcaccgtct

SEQ ID NO: 453934 - DNA, 491 bp, Homo sapiens; identical to SEQ ID NO: 447010
  misc_feature: HEFZJCU01CAKRE.4.7.A07.1.454.heavy.3.raw

SEQ ID NO: 453935 - DNA, 516 bp, Homo sapiens
  misc_feature: HEFZJCU01CHKGZ.18.85.H08.1.454.heavy.3.raw
tacgagtatgcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcagtttcagtgcctactggatgcactggatccgccaagttccagggaagagactggtgtgggtctcacgtattaaagatgatgggggtgccacatcctacgcggactccgtgaggggccgcttcaccatctcccgagacaacaccaagaacacgctgtatctgcaaatgagcagtctgggagtcgaggacacggctgtctattactgtgcaagaggggactacggtgcctacgaggggttggtcgacccctggggccagggaaccctggtcaccgtctcctcacg

SEQ ID NO: 453936 - DNA, 527 bp, Homo sapiens
  misc_feature: HEFZJCU01DBAAB.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatccctgaaagcgtcaactactactactacggtatggacctc

SEQ ID NO: 453937 - DNA, 491 bp, Homo sapiens
  misc_feature: HEFZJCU01DMKD7.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacatagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagt

SEQ ID NO: 453938 - DNA, 511 bp, Homo sapiens; identical to SEQ ID NO: 448280
  misc_feature: HEFZJCU01BO4BG.16.71.G05.1.454.heavy.3.raw

SEQ ID NO: 453939 - DNA, 497 bp, Homo sapiens; identical to SEQ ID NO: 445179
  misc_feature: HEFZJCU01CQ7SB.12.55.E11.1.454.heavy.3.raw

SEQ ID NO: 453940 - DNA, 372 bp, Homo sapiens; identical to SEQ ID NO: 444513
  misc_feature: HEFZJCU01D071C.5.23.C01.1.454.heavy.3.raw

SEQ ID NO: 453941 - DNA, 532 bp, Homo sapiens
  misc_feature: HEFZJCU01D0CYF.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgacttttggggccaggggaaacctggtccaccgtcctccccagccttccaccaagggcccagtccgtccttcccccg

SEQ ID NO: 453942 - DNA, 496 bp, Homo sapiens; identical to SEQ ID NO: 446592
  misc_feature: HEFZJCU01DD0AM.4.75.G09.1.454.heavy.3.raw

SEQ ID NO: 453943 - DNA, 529 bp, Homo sapiens
  misc_feature: HEFZJCU01BZT12.19.48.E04.1.454.heavy.3.raw
tactctcgtgcacgaccggtgctcgatttagagagcgtcacagagagaaggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgccaggctccggggaaggggccggagtgggtggccaacataatgcaagatggaactgagaaaaactatggggactctgtgaagggccgattcaccatctccagagacaaccgtaagaacttactgttctgcaatgaacagcctgagagccgaggacacggctgtgtattattgtgcgaagggcagtggctgggacatggacgtctggggccaagggaccacggtcaccggt

SEQ ID NO: 453944 - DNA, 510 bp, Homo sapiens
  misc_feature: HEFZJCU01EX5XL.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggcctgggctgcctggtcaaggactactt

SEQ ID NO: 453945 - DNA, 521 bp, Homo sapiens
  misc_feature: HEFZJCU01BCENQ.9.33.C11.1.454.heavy.3.raw
tgatacgtctcacgaccggtgctcgatttagagtgagctcgttgggtttgggctgagcgtggtttcgtcgtaggctctttaagtaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgttttattactgtacgaaagaggggggatacagtggcagctccaagtactactttgacttctgggccagggaaccctggtcaccgtctcctcagcctccaccaagggcccatcggtcttcccctgcgcctgctccaggagcacctccg

SEQ ID NO: 453946 - DNA, 523 bp, Homo sapiens
  misc_feature: HEFZJCU01ERZ8J.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgtttcgagacatgccgaccgagagcattatcggcagtacggttttgattatttggggccaagggacaagggtcaccgtctccgcagcctccaaccg

SEQ ID NO: 453947 - DNA, 510 bp, Homo sapiens
  misc_feature: HEFZJCU01E0MB1.49.20.B09.1.454.heavy.3.raw
agtcgagagacacgaccggtgctcgatttagtgtagtgtgaaggggacccaacaaccacatccctcctcagaagcccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatggatcaccgctggcaatggtgacacaaaatattcagagaagttccagggcagagtctccattaccagggacacagctgcgagtacagggtacatggaactgagtggcctgagatctgaggacacggctgtttattactgtgcgagagggaagtgggatattgtggcagctcgaggtcgcccaggcccgggcccctatttcgactactc

SEQ ID NO: 453948 - DNA, 493 bp, Homo sapiens
  misc_feature: HEFZJCU01CJH7A.48.78.H01.1.454.heavy.3.raw
agtatacatacacgaccggtgctcgatttagtgtgagtagtttgggtttggggacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagatatggacaactttc

SEQ ID NO: 453949 - DNA, 505 bp, Homo sapiens
  misc_feature: HEFZJCU01DEXUP.17.25.C03.1.454.heavy.3.raw
cgtagactagcacgaccggtgctcgatttagtagtgtagatttgggtttggggactcaacaaccacatctgtcctctagagaaaaccctatgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacggcaggcggcctttgacttctc

SEQ ID NO: 453950 - DNA, 515 bp, Homo sapiens; identical to SEQ ID NO: 447834
  misc_feature: HEFZJCU01C3SCV.3.20.B09.1.454.heavy.3.raw

SEQ ID NO: 453951 - DNA, 506 bp, Homo sapiens
  misc_feature: HEFZJCU01DH41Z.53.33.C11.1.454.heavy.3.raw
cgcgtatacacacgaccggtgctcgatttagagtgagctcgttgggtttgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaagggcccatcggtcttccccctggcgccctgctccagagcacctctgggggcacagcggccctgggctgcctggtcaaggactacttcctcgtact

SEQ ID NO: 453952 - DNA, 507 bp, Homo sapiens
  misc_feature: HEFZJCU01D5SNN.53.34.D01.1.454.heavy.3.raw
cgcgtatacacacgaccggtgctcgatttagatcgtctgtgttgggtttgggggggagaggagcccagcactgggattccgaggtgtttccattcggtgatcagcactgaacacagaggactcaccatggagttttggctgagctgggttttccttgttgctattttaaaaggtgtccagtctgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccaagaacacactgtttcttcaaatggacttcctgagaactgaggacacggccgtgtattactgcgcgagagtgcatgatagtggtttccatgatgcttttgat

SEQ ID NO: 453953 - DNA, 524 bp, Homo sapiens
  misc_feature: HEFZJCU01B2OXX.12.40.D07.1.454.heavy.3.raw
  modified_base (495)..(495): a, c, t, g, unknown or other
  modified_base (513)..(513): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgagggggccgattcaccatctccagagacaattacaagaacaccctttatctgcaaatagacagcctgagaccagacgacacggctgtctattattgcgcgagagagacacacgaacctactggccaatactatgggggcttgttctggggtccaggggaccctggtcatcgtctccccagcctccnccaagggcccatccggtnttcccctggcg

SEQ ID NO: 453954 - DNA, 498 bp, Homo sapiens; identical to SEQ ID NO: 448922
  misc_feature: HEFZJCU01DYFMT.11.73.G07.1.454.heavy.3.raw

SEQ ID NO: 453955 - DNA, 515 bp, Homo sapiens
  misc_feature: HEFZJCU01C56BR.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcagtcgacactttgattactggggccgggaaccctggtcgccgtctcctcagcctccaccaagggcccatcggtcttccccctggcaccctcctccaagagcacctctgggggcacagcgccctggctgcctggtcaaggactacttccagacgtatca

SEQ ID NO: 453956 - DNA, 391 bp, Homo sapiens; identical to SEQ ID NO: 446378
  misc_feature: HEFZJCU01B2BYJ.16.24.C02.1.454.heavy.3.raw

SEQ ID NO: 453957 - DNA, 550 bp, Homo sapiens
  misc_feature: HEFZJCU01CEN19.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaaagacgaagacacggggcgtgtatttttgtgtgaaagatacgaagtctatgatacccaatttgggaggggcctttcatgtctgggccaagggacgctggtcaccgtctcttcagcctccaccaagggcccagtccggtccttcccctcggtccacccttcctcccaagagccacctcgtggggggcacgagcc

SEQ ID NO: 453958 - DNA, 513 bp, Homo sapiens
  misc_feature: HEFZJCU01BUOJL.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcaagaaaaactatgtggactctgtgaacggccgattcaccatctccagagacaacgccaagaattcactgtatttgcaaatgaacagcctgagaggcgaggacacggccgtgtattattgtgcgcgagatgatagtagactctacagtagcaggtggta

SEQ ID NO: 453959 - DNA, 523 bp, Homo sapiens
  misc_feature: HEFZJCU01AFXYY.49.27.C05.1.454.heavy.3.raw
agtcgagagacacgaccggtgctcgatttagacgcgatcgaagggtttggggaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggattttgactactggggccaggggaaccccggtcaccgtctcctctgcctccaccaaggg

SEQ ID NO: 453960 - DNA, 521 bp, Homo sapiens
  misc_feature: HEFZJCU01B9OWS.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccagggcccatcggtcttccccctggcg

SEQ ID NO: 453961 - DNA, 525 bp, Homo sapiens
  misc_feature: HEFZJCU01BYG7R.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcggtcttcccctggcgccctgctccaggagcacctccgagagcacagcggccctgggcc

SEQ ID NO: 453962 - DNA, 506 bp, Homo sapiens; identical to SEQ ID NO: 446520
  misc_feature: HEFZJCU01AJSGF.10.38.D05.1.454.heavy.3.raw

SEQ ID NO: 453963 - DNA, 480 bp, Homo sapiens; identical to SEQ ID NO: 446065
  misc_feature: HEFZJCU01B1PR6.15.38.D05.1.454.heavy.3.raw

SEQ ID NO: 453964 - DNA, 518 bp, Homo sapiens; identical to SEQ ID NO: 444718
  misc_feature: HEFZJCU01A3ZKG.9.34.D01.1.454.heavy.3.raw

SEQ ID NO: 453965 - DNA, 396 bp, Homo sapiens; identical to SEQ ID NO: 444469
  misc_feature: HEFZJCU01EGJWC.47.46.E02.1.454.heavy.3.raw

SEQ ID NO: 453966 - DNA, 506 bp, Homo sapiens
  misc_feature: HEFZJCU01D7M7V.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgcctgctccagagcacctccgagagcacagcggccctggactgcctggtcaaggactacttccgagtgcgtct

SEQ ID NO: 453967 - DNA, 494 bp, Homo sapiens
  misc_feature: HEFZJCU01B5S2V.14.81.H04.1.454.heavy.3.raw
cgtctagtaccacgaccggtgctcgatttagtagtgtagattcgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcggggggaggcgtggtccagcctgggaggtccctgagactctcctgtgcagcctctggattcaccgtcagtagttctggcatgcactgggtccgccaggctccaggcaaggggctgggattggggtgggagttatatcatatgatggaactaataaagactatgcagactccgtgaagggccgattcaccatctccagagacacttccaggaacacgctgtatctgcaaatgaacagcctgagagctgaggacacggcagtgtattactgtgcgaaagataggtcggtag

SEQ ID NO: 453968 - DNA, 379 bp, Homo sapiens; identical to SEQ ID NO: 444450
  misc_feature: HEFZJCU01B1IH8.47.77.G11.1.454.heavy.3.raw

SEQ ID NO: 453969 - DNA, 526 bp, Homo sapiens
  misc_feature: HEFZJCU01CTOM0.53.10.A10.1.454.heavy.3.raw
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgttctgcagatgcacaacttgagagtcgaagacacggcggtctatttctgcgcgaggaaaagtcgcattccagagcctgtacgcccgccttggtctcgtcagttggtcaatccgccctccagggggacctttgggggtttcgacccctggggccaggggaaccctggtcaccgtctcctcagcctccaccaagggcccatcggtcttcccctggcaccctcctccaagagcacctcg

SEQ ID NO: 453970 - DNA, 518 bp, Homo sapiens; identical to SEQ ID NO: 444718
  misc_feature: HEFZJCU01BTJOG.9.34.D01.1.454.heavy.3.raw

SEQ ID NO: 453971 - DNA, 518 bp, Homo sapiens; identical to SEQ ID NO: 444718
  misc_feature: HEFZJCU01A0DGA.9.34.D01.1.454.heavy.3.raw

SEQ ID NO: 453972 - DNA, 513 bp, Homo sapiens
  misc_feature: HEFZJCU01DGPH6.3.71.G05.1.454.heavy.3.raw
agacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaaggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgtagtaaggtacccggggaaatatgtacgtattttggaactt

SEQ ID NO: 453973 - DNA, 505 bp, Homo sapiens
  misc_feature: HEFZJCU01ERC3U.51.80.H03.1.454.heavy.3.raw
cgatcgtatacacgaccggtgctcgatttagctgtgcgtcgaagggaaaggggaggtgtcctgtcacaggtacagctgcagcagtcaggtccaggactggtgaagccctcgcagaccctcccactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaacccagacacatccaagaaccagttctccctgcaactgaactctgtgactcccgaggacacggccgtgtattactgtgcaagaggttggttaacagctggaggatttgactactggggccagggaaccctggtcaccgtctcctcagcctccaccaagggcccatcggtcttccccctggcgccctgctccaggagcacctccgagagcacagcggccc

SEQ ID NO: 453974 - DNA, 482 bp, Homo sapiens; identical to SEQ ID NO: 446046
  misc_feature: HEFZJCU01BGMDP.10.35.D02.1.454.heavy.3.raw

SEQ ID NO: 453975 - DNA, 493 bp, Homo sapiens; identical to SEQ ID NO: 447050
  misc_feature: HEFZJCU01AY0JT.10.71.G05.1.454.heavy.3.raw

SEQ ID NO: 453976 - DNA, 527 bp, Homo sapiens
  misc_feature: HEFZJCU01DXC2T.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccccggcgtcgccgcgtcgacgaacgtacttaccctacctactactgtcgtcgtaggcggcggtcggcgacggacggccgatag

SEQ ID NO: 453977 - DNA, 491 bp, Homo sapiens
  misc_feature: HEFZJCU01EAPZB.40.85.H08.1.454.heavy.3.raw
tctagcgactcacgaccggtgctcgatttagtatcactcagtcgcggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccagggaaccctggtcaccgtctcctcagcctccaccaagggcccatcggtcttcccctggcgccctgctccaggagcacctccgagagcacagccggccctgggctgcctggtcaaggactacttccagtcgctaga

SEQ ID NO: 453978 - DNA, 372 bp, Homo sapiens; identical to SEQ ID NO: 450118
  misc_feature: HEFZJCU01CCDY0.12.86.H09.1.454.heavy.3.raw

SEQ ID NO: 453979 - DNA, 508 bp, Homo sapiens; identical to SEQ ID NO: 449566
  misc_feature: HEFZJCU01DNVMO.8.38.D05.1.454.heavy.3.raw

SEQ ID NO: 453980 - DNA, 499 bp, Homo sapiens
  misc_feature: HEFZJCU01CKZO2.53.1.A01.1.454.heavy.3.raw
cgcgtatacacacgaccggtgctcgatttagacgtctcatcagggggagcatcacataacaaccagattcctcctctaaagaagcccctgggagcacagctcatcaccatggactggacctggaggttcctctttgtggtggcagcagctaccggtgtccagtcccaggtccacctggtgcaatccgggactgaggtgaagaagcctgggtcctcggtgaaggtctcctgcaaggcctctggagacaccttcaacagttatggtatcagttgggtgcgacaggcccctggacaagggcttgagtggatgggaaggatcatcccaatccttggtattacaaaaatgcacagaggtttcagggcagagtcctgttaaccgcggacaaatccactaccacagtctacatggagctgagcagcctgagatctgaagacacggccctgtactattgtgcgagagaaatgtacttctatgacagtactaatcaatatgcttttga

SEQ ID NO: 453981 - DNA, 524 bp, Homo sapiens; identical to SEQ ID NO: 445728
  misc_feature: HEFZJCU01CJF22.5.33.C11.1.454.heavy.3.raw

SEQ ID NO: 453982 - DNA, 507 bp, Homo sapiens
  misc_feature: HEFZJCU01ESDH2.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctaggggccagggacg

SEQ ID NO: 453983 - DNA, 537 bp, Homo sapiens
  misc_feature: HEFZJCU01ASXSD.15.87.H10.1.454.heavy.3.raw
tctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaagaacttactgtatctgcaaatgaacagcctgagaggcgaggacacggctctgtattactgtgcgaggatacctcctctggcgggccaggtttcctacggcatggacgtctggggccaagggaccacggtcaccgtctcctcagcctccaccaaggcccatcggtcttcccctggcaccctcctccaagagcacctctgggggcacgacgcggccctggctgcctggtcg

SEQ ID NO: 453984 - DNA, 517 bp, Homo sapiens
  misc_feature: HEFZJCU01DB9E2.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaagggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctct

SEQ ID NO: 453985 - DNA, 519 bp, Homo sapiens; identical to SEQ ID NO: 444867
  misc_feature: HEFZJCU01ESOIJ.9.34.D01.1.454.heavy.3.raw

SEQ ID NO: 453986 - DNA, 494 bp, Homo sapiens
  misc_feature: HEFZJCU01CQVVR.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagttgagcagcctgagatctgacgacacggcgtttattactgtgcgcgagataatagtcacaactggaacggcgttttggggt

SEQ ID NO: 453987 - DNA, 482 bp, Homo sapiens; identical to SEQ ID NO: 444503
  misc_feature: HEFZJCU01CH8BT.7.10.A10.1.454.heavy.3.raw

SEQ ID NO: 453988 - DNA, 528 bp, Homo sapiens
  misc_feature: HEFZJCU01CVZQ4.49.65.F10.1.454.heavy.3.raw
agtcgagagacacgaccggtgctcgatttagctacgctctaagggggggagaggagcccagcactagaagtcggcggtgtttccattcggtgatcagcactgaacacagacctccaaccatggagtttgggcttagctgcgttttccttgttgctattttaaaaggtgtccattgtgaggtgcagctggttgagtctgggggaggcttggtacagcccgggcggtccctgagactctcctgtgtaacctcaggattcatctttggtgattatggaatgacctgggtccgccaggctccagggaagggcctggagtgggtagctttcgttagcagaaagactgaaggtgggacaacagaatacggcgcgtctgtgaaaggcagatttatcatctcaagagacgattccaaaggcatcgcctatctgcaaatgaacagcctgaaaaccgaggacacagccgtgtattttgtactagagtcttcttgtattaccatgatactagtggttttacaggagcggggcacggtat

SEQ ID NO: 453989 - DNA, 493 bp, Homo sapiens
  misc_feature: HEFZJCU01BNNS5.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactacgtggggccagggaaccctggtcaccgtctcctcagcctccaccaagggcccatcggtcttcccctggcgccctgctccaggagcacctccgagagcacagcggccctgggctgcctggtcaaggactacttcccacgacgagta

SEQ ID NO: 453990 - DNA, 500 bp, Homo sapiens
  misc_feature: HEFZJCU01C8S3G.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccctggcgcctgctcc

SEQ ID NO: 453991 - DNA, 492 bp, Homo sapiens; identical to SEQ ID NO: 445919
  misc_feature: HEFZJCU01DS0LX.14.25.C03.1.454.heavy.3.raw

SEQ ID NO: 453992 - DNA, 491 bp, Homo sapiens; identical to SEQ ID NO: 444592
  misc_feature: HEFZJCU01CBS77.11.26.C04.1.454.heavy.3.raw

SEQ ID NO: 453993 - DNA, 515 bp, Homo sapiens
  misc_feature: HEFZJCU01E0D4U.13.36.D03.1.454.heavy.3.raw
tcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctctggtgggttcttcagtggttactactggagctggatccgccagtccccagggaaggggctggagtggattggggaaatcaatcatagtggaagcaccaactacaacccgtccctcgagagccgagtcaccatgtcagtagacacgtccaagaaccagttctccctgagggtgagctctgtgaccgccgcggacacggctgtgtacttctgtgcgagaggcaatttttggactcgtcattctccctttgactttctggggccaggggaaccctagtcaccgtc

SEQ ID NO: 453994 - DNA, 396 bp, Homo sapiens; identical to SEQ ID NO: 444469
  misc_feature: HEFZJCU01D4B03.47.46.E02.1.454.heavy.3.raw

SEQ ID NO: 453995 - DNA, 509 bp, Homo sapiens
  misc_feature: HEFZJCU01DFBPG.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttggacttctggggccagggacg

SEQ ID NO: 453996 - DNA, 502 bp, Homo sapiens
  misc_feature: HEFZJCU01B8CRG.10.38.D05.1.454.heavy.3.raw
catagtagtgcacgaccggtgctcgatttagtatctgatagttgggtttgggtgccgaaccgttgctggaggtcacggtcaccacgctgctgagggagtagggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctgacgccctgctccaggagcacctccgagagcacagcggccctgggctgcctggtcaaggactactcccactact

SEQ ID NO: 453997 - DNA, 516 bp, Homo sapiens
  misc_feature: HEFZJCU01CDDYF.26.71.G05.1.454.heavy.3.raw
agactatactcacgaccggtgctcgatttagtgtcgtcgcaagagagagggggggggaagaggaagactgacggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagatatgactattggggccagggaattttggtcaccgtctccccagcctccaccaagggcccatcggtcttcccctggccgccctgctccaggagcacctccgagagcacagcggccctgggctgcctggtcaaggactacttcc

SEQ ID NO: 453998 - DNA, 518 bp, Homo sapiens; identical to SEQ ID NO: 446149
  misc_feature: HEFZJCU01AWAIM.52.78.H01.1.454.heavy.3.raw

SEQ ID NO: 453999 - DNA, 500 bp, Homo sapiens
  misc_feature: HEFZJCU01C5JVK.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaggcctggtcaccgtctcctcagcctccaccaagggcccatcggtcttcccctggcgccctgctccaggagcacctccgagagcacagcggccctgggctgcctggtcaaggactacttcctacgtcgtat

SEQ ID NO: 454000 - DNA, 519 bp, Homo sapiens
  misc_feature: HEFZJCU01B791Q.8.34.D01.1.454.heavy.3.raw
ctcgcgtgtccacgaccggtgctcgatttagatcgtctgtgttgggtttgggggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctggggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaagggagggggaaccaggcgggagttccaagtactcctt

SEQ ID NO: 454001 - DNA, 511 bp, Homo sapiens
  misc_feature: HEFZJCU01CDPX6.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgaccacggccatatattactgtgcgaaagcaccggcagttagtcacccatactactttgactacgtgggccg

SEQ ID NO: 454002 - DNA, 492 bp, Homo sapiens; identical to SEQ ID NO: 446150
  misc_feature: HEFZJCU01EF51H.4.57.F02.1.454.heavy.3.raw

SEQ ID NO: 454003 - DNA, 506 bp, Homo sapiens
  misc_feature: HEFZJCU01A0JEL.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcgaccatgacctgggacgcgtccatcagcacaagtctacatggatctgagcggactgacctctgacgacacggccatgtattactgtggaagagacgttggtggtctaccgcgggggctgaccactgggggaccg

SEQ ID NO: 454004 - DNA, 396 bp, Homo sapiens; identical to SEQ ID NO: 444469
  misc_feature: HEFZJCU01DWBRV.47.46.E02.1.454.heavy.3.raw

SEQ ID NO: 454005 - DNA, 527 bp, Homo sapiens
  misc_feature: HEFZJCU01CN73L.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaactcgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgtaccagtggggccggggaaccctggtcaccgtctcttcagcctccaccaacgggcccactcggtcttcccccgtcggccaccctcctcccaagacgcacctcctgggggcacac

SEQ ID NO: 454006 - DNA, 503 bp, Homo sapiens
  misc_feature: HEFZJCU01C0YSV.51.71.G05.1.454.heavy.3.raw
cgatcgtatacacgaccggtgctcgatttagtgtcgtcgcaagagagaggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttccccctggcaccctcctcccaagagcacctctgggggcacagcggcctgggctgcctggtcaaggactactt

SEQ ID NO: 454007 - DNA, 483 bp, Homo sapiens; identical to SEQ ID NO: 444532
  misc_feature: HEFZJCU01E08U3.47.59.F04.1.454.heavy.3.raw

SEQ ID NO: 454008 - DNA, 522 bp, Homo sapiens; identical to SEQ ID NO: 446788
  misc_feature: HEFZJCU01B37VA.12.40.D07.1.454.heavy.3.raw

SEQ ID NO: 454009 - DNA, 403 bp, Homo sapiens; identical to SEQ ID NO: 445029
  misc_feature: HEFZJCU01C6DPJ.10.77.G11.1.454.heavy.3.raw

SEQ ID NO: 454010 - DNA, 545 bp, Homo sapiens
  misc_feature: HEFZJCU01DTEQ6.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacaccggccctttattactgtgcgaaggatcgcccctataatggtggctggagtcgggggagtttgggttccgtggggccacgggaacctggtcc

SEQ ID NO: 454011 - DNA, 400 bp, Homo sapiens; identical to SEQ ID NO: 444452
  misc_feature: HEFZJCU01DUJ4E.47.24.C02.1.454.heavy.3.raw

SEQ ID NO: 454012 - DNA, 505 bp, Homo sapiens
  misc_feature: HEFZJCU01D93L5.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcgggggaggcttggtacagcctgggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtggaaatgaacagtctgagagccgagaacacggctctctattactgtgcgagacgaccccgaaaatacgggtctacg

SEQ ID NO: 454013 - DNA, 488 bp, Homo sapiens
  misc_feature: HEFZJCU01CFS72.4.21.B10.1.454.heavy.3.raw
agcactgtagcacgaccggtgctcgatttagtgtcgtcgcaagagaggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggccatcgtcttcccctgcgccctgctccagagcacctccgagagcacagcgcccgtgggctgcctgtcaggactacttccctacagtgct

SEQ ID NO: 454014 - DNA, 416 bp, Homo sapiens
  misc_feature: HEFZJCU01C0TEV.14.37.D04.1.454.heavy.3.raw
cgtctagtaccacgaccggtgctcgatttagtagcatactgttgggtttgggtgcgccagatgcccgggaaaggcctggagtggatgggaaggatcgaccccattgactcttatacgtactacagcccttctttccaaggccacgtcaccatctcaactgacaagtccacaagtactgcctacctgcagtggagcaacctgagggcctcggacaccgccatctattactgtgcgagacgtaattgtgttaatatgaactgttatttcagggactggggccagggaaccctggtcaccgtctcctcagcctccaccaagggcccatcggtcttccccctggcaccctcctccaagagcacctctgggggcacagcggccctgggctgcctggtcaaggactacttccgtactagacg

SEQ ID NO: 454015 - DNA, 509 bp, Homo sapiens
  misc_feature: HEFZJCU01BY7X9.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaagggctggagtgggtgccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctacgtggggcccgggagccctgggt

SEQ ID NO: 454016 - DNA, 521 bp, Homo sapiens
  misc_feature: HEFZJCU01B4M0S.9.34.D01.1.454.heavy.3.raw
tgatacgtctcacgaccggtgctcgatttagatcgtctgtgttggggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgtcctggtcaaggactacttccagacgtatca

SEQ ID NO: 454017 - DNA, 522 bp, Homo sapiens
  misc_feature: HEFZJCU01ETUDG.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggccg

SEQ ID NO: 454018 - DNA, 499 bp, Homo sapiens; identical to SEQ ID NO: 447792
  misc_feature: HEFZJCU01B3SSJ.17.10.A10.1.454.heavy.3.raw

SEQ ID NO: 454019 - DNA, 522 bp, Homo sapiens
  misc_feature: HEFZJCU01BJGE0.48.34.D01.1.454.heavy.3.raw
agtatacatacacgaccggtgctcgatttagatcgtctgtgttgggtttgggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggcctccagagtcgagccctcatatccatagacacgtccaacaaccagttttccctgacgctgacgtctgtgaccgccgcagacacggctgtctattattgtgcgagactaggcttctgtagtggtggtacttgcaacccgggatactactccaacttcggcttggacatctggggccaagggacctc

SEQ ID NO: 454020 - DNA, 483 bp, Homo sapiens
  misc_feature: HEFZJCU01DI3P6.16.34.D01.1.454.heavy.3.raw
tgtactactccacgaccggtgctcgatttagatcgtctgtgttgggtttgggggaggcttgacccagccgggggggtccctgagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccgattcaccatctccagagacaattccaagaacacggtgaatcttcaaatgaacagcctgagaaccgaggacacggccgtatattattgtataggttatggtggtaattcgggcccctggggccagggaaccgtggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 454021 - DNA, 508 bp, Homo sapiens; identical to SEQ ID NO: 446002
  misc_feature: HEFZJCU01BCWL7.9.78.H01.1.454.heavy.3.raw

SEQ ID NO: 454022 - DNA, 510 bp, Homo sapiens
  misc_feature: HEFZJCU01AOPCV.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactgggccagggaacctggtcgtcccg

SEQ ID NO: 454023 - DNA, 504 bp, Homo sapiens
  misc_feature: HEFZJCU01BCT3Y.13.79.H02.1.454.heavy.3.raw
tcacgtactacacgaccggtgctcgatttagtgtcacacgaagggaaagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagttggaagtgagaaatactatgtggactctgtgaagggccgattcaccatctccagagacaacgccaagaactcactgtatctgcaaatgaacagcctgagagccgaggacacggctgtctattactgtgcgagagagttgggggcggaaggtatagca

SEQ ID NO: 454024 - DNA, 491 bp, Homo sapiens
  misc_feature: HEFZJCU01BXHRZ.52.34.D01.1.454.heavy.3.raw
  modified_base (370)..(370): a, c, t, g, unknown or other
cgcagtacgacacgaccggtgctcgatttagatcgtctgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcggagcagccccgtaattctggggccagggaacccggtnaccgtctcctcagcctccaccaagggcccatcggtcttcccctggcaccctcctccaagagcacctctgggggcacagcggccctgggctgcctggtcaaggactacttcctatacgatcg

SEQ ID NO: 454025 - DNA, 519 bp, Homo sapiens; identical to SEQ ID NO: 452709
  misc_feature: HEFZJCU01C024Y.3.82.H05.1.454.heavy.3.raw

SEQ ID NO: 454026 - DNA, 512 bp, Homo sapiens; identical to SEQ ID NO: 450914
  misc_feature: HEFZJCU01D6RJP.15.67.G01.1.454.heavy.3.raw

SEQ ID NO: 454027 - DNA, 504 bp, Homo sapiens
  misc_feature: HEFZJCU01ASJPL.13.11.A11.1.454.heavy.3.raw
tcacgtactacacgaccggtgctcgatttagctacgactgcaggggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcatctttgatgattatgccatgcactgggtccggcaagctccgagggaaggcctggagtgggtctcaggtattagtggaatagtggtaacataggctatgcggactctgtgaagggccgattcaccatctccagagacaacgccaagaactccctgtatctgcaaatgaacagtctgagagctggaggacgacggccgttagtattacgtgtgcgaaaaggtcctatttagctaggtggcgttc

SEQ ID NO: 454028 - DNA, 386 bp, Homo sapiens
  misc_feature: HEFZJCU01BUKZF.14.72.G06.1.454.heavy.3.raw
cgtctagtaccacgaccggtgctcgatttagctacgactgcaagggaaagggcctggagtggatgggagtcatctttcctgctgactctgataccagatacagcccgtccttccgaggccaggtcaccatctcggccgacaagtccatcagcaccgcctacctgcagtggagcagccttgaggcctcggacaccgccatgtatttctgtgcgacccagcgggaggacttcaactttgacttctggggccagggaaccctgataaccgtctccgcagcctcctaccaagggcccatcggtcttccccctggcgccctgctccaggagcacctccgagagcacagcggccctgggctgcctggtcaaggactacttccgtactagacg

SEQ ID NO: 454029 - DNA, 409 bp, Homo sapiens; identical to SEQ ID NO: 444519
  misc_feature: HEFZJCU01BD2HV.3.41.D08.1.454.heavy.3.raw

SEQ ID NO: 454030 - DNA, 528 bp, Homo sapiens
  misc_feature: HEFZJCU01CX9GD.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgacttctgggccatcggaacccggtccg

SEQ ID NO: 454031 - DNA, 530 bp, Homo sapiens
  misc_feature: HEFZJCU01B9ZI6.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaagggcccatcggtcttcccctggcaccctcctccagagcacctctgggggcacagcggccctgggctgcct

SEQ ID NO: 454032 - DNA, 505 bp, Homo sapiens
  misc_feature: HEFZJCU01BEOOM.52.57.F02.1.454.heavy.3.raw
cgcagtacgacacgaccggtgctcgatttagctcgatatagttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctgggctgcctggtcaaggactacttcctatacgatcg

SEQ ID NO: 454033 - DNA, 436 bp, Homo sapiens
  misc_feature: HEFZJCU01CGUE6.3.21.B10.1.454.heavy.3.raw
agacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgttattactgtgcaagagcgaggaggagcagttttgacagctggggccagggaaccctggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 454034 - DNA, 513 bp, Homo sapiens
  misc_feature: HEFZJCU01DYK79.52.83.H06.1.454.heavy.3.raw
cgcagtacgacacgaccggtgctcgatttagatcacgtgcgtcgcgggggggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttatatcaaatgatggaagtaacaaatactatgtagactccgtgaagggccgattcaccatctccagagacaattccaagaatacgctgtatctgcacatgaacagcctgagagaccgaagacgacgggtgtttatactgtacgaacttaattacggagacaacggtaaccccgtcgacacggcac

SEQ ID NO: 454035 - DNA, 391 bp, Homo sapiens
  misc_feature: HEFZJCU01BJIHY.16.17.B06.1.454.heavy.3.raw
tgtactactccacgaccggtgctcgatttagtcgatagtgaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgacgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 454036 - DNA, 493 bp, Homo sapiens; identical to SEQ ID NO: 453100
  misc_feature: HEFZJCU01EMA54.14.25.C03.1.454.heavy.3.raw

SEQ ID NO: 454037 - DNA, 422 bp, Homo sapiens
  misc_feature: HEFZJCU01CZSFH.40.70.G04.1.454.heavy.3.raw
tctagcgactcacgaccggtgctcgatttagtgtagtgtgaagggaagggactggagtggattgcggctatttcttatagtgagaacacctactacaacccgtccctcaagagtcgagtcaccatatccgtagacacgtccaacaaccagttctccctgaacctgagccctgtgaccgtcgcagacacggctgtatattattgtgggagacgctttcgtgacttaggccctgactacggtggcccccataccgaggacgatttcctcggtatggacgtctggggccaagggaccacggttaccgtctcctcagcctccaccaagggcccatcggtcttccccctggcgccctgctccaggagcacctccgagagcacagcggccctgggctgcctggtcaaggactacttccagtcgctaga

SEQ ID NO: 454038 - DNA, 506 bp, Homo sapiens
  misc_feature: HEFZJCU01CKBRX.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatgttcggggattatagtccctatttgactactgggccagggactctggtcaccgtctccgcagcctcaccaagggccc

SEQ ID NO: 454039 - DNA, 494 bp, Homo sapiens
  misc_feature: HEFZJCU01ATO26.49.35.D02.1.454.heavy.3.raw
agtcgagagacacgaccggtgctcgatttagcacacgatagttgggtttggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcggacaaatccacgaacacagcctacatggaactgcgcagcctaggatctgccgacacggccgtatatttctgtgcgagagagatgtctttctatgatagtactagtcatt

SEQ ID NO: 454040 - DNA, 520 bp, Homo sapiens
  misc_feature: HEFZJCU01CKALE.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtccccagggaagggactggagtggattgggtatatctattacactgggagcaccgactacagcccctccctcatgagtcgagtcaccatttcactagacacgtccaagaaccagttctccctgaaactgaggtctgtgaccgctgcggacacggccgtctattactgtgcgagatttgctttttggagtggttacgccgcgtttgactactggggccagggaaccctggtcaccgtctcctcagcctccaccg

SEQ ID NO: 454041 - DNA, 508 bp, Homo sapiens
  misc_feature: HEFZJCU01CNM1Q.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcagacacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgtaccgaagatgaagggcagagtcacgattaccacggacacccccacgaacacagtctacatgcaactgacgagcctgagagctgacgacacggccgtctattactgtgcgagaatgtttctgtcatcgtacaatttgataggctctatggactggactttcgtggggccg

SEQ ID NO: 454042 - DNA, 518 bp, Homo sapiens
  misc_feature: HEFZJCU01CI2DU.9.37.D04.1.454.heavy.3.raw
tgatacgtctcacgaccggtgctcgatttagtagcatactgttgggtttggggtctgagagaggagcccagccctgggattttcaggtgttttcatttggtgatcaggactgaacagagagaactcaccatggagtctgggctgagctggcttcttcttgtggctattttaaaaggtgtccagtgtgaggtgcatctattggagtctgggggagccctggtacagccgggggggtccctgacactctcctgtacagcctctggattcacctttaacacctatgcattgagctgggtccgccaggccccagggaaggggctggactgggtcgcagccattagtggcaatggcgaaaacacatattacgcagactccgtgaagggccggttcaccatttccagagacaatttcaagaacacgctgtatctgcagatgaacagcctgagagccgaggacacggccgtatatcactgtgccaaagatcagaaggacggttcggggagttacaaatattacta

SEQ ID NO: 454043 - DNA, 522 bp, Homo sapiens
  misc_feature: HEFZJCU01ES26L.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgatgccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcttggtcaaggactactt

SEQ ID NO: 454044 - DNA, 489 bp, Homo sapiens
  misc_feature: HEFZJCU01DRT09.53.62.F07.1.454.heavy.3.raw
cgcgtatacacacgaccggtgctcgatttagtagtcgcataaagggaaagggggggagacgagcccagcactggaagtcgccggtgtttccattcggtgatcatcactgaacacagaggactcaccatggagtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctatgcactgggtccgccaggctccaggcaaggggctggagtgggtggcacttatcctcatctgatggaagagatgtctattacgcagactccgtgaagggccgattcaccatctccagagacaattccaagaacacactgtatctgcaaatggacagtctgagaactgaagacacgctgtgtattactgtgcgagtgagatgtctact

SEQ ID NO: 454045 - DNA, 500 bp, Homo sapiens
  misc_feature: HEFZJCU01AHRD4.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcagtggtcttttgatgtcctttgatatgtggggccaagggacaagtggtcaccgtct

SEQ ID NO: 454046 - DNA, 388 bp, Homo sapiens
  misc_feature: HEFZJCU01A4SFR.52.34.D01.1.454.heavy.3.raw
cgcagtacgacacgaccggtgctcgatttagatcgtctgtgttggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttccccctggcaccctcctccaagagcacctcgtggggcacagcggccctgggctgcctggtcaaggactacttcctatacgatcg

SEQ ID NO: 454047 - DNA, 394 bp, Homo sapiens; identical to SEQ ID NO: 444701
  misc_feature: HEFZJCU01DNYMV.3.12.B01.1.454.heavy.3.raw

SEQ ID NO: 454048 - DNA, 379 bp, Homo sapiens; identical to SEQ ID NO: 444450
  misc_feature: HEFZJCU01E0ELN.47.77.G11.1.454.heavy.3.raw

SEQ ID NO: 454049 - DNA, 508 bp, Homo sapiens
  misc_feature: HEFZJCU01EZN0Y.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgttattactgtgcgcgatctggcgactcagtgactatggtatggacgtctggggccgaagggaccacggtcatcgtctcctcagcctccaccaagggcccatcggtcttcccctgc

SEQ ID NO: 454050 - DNA, 528 bp, Homo sapiens; identical to SEQ ID NO: 445974
  misc_feature: HEFZJCU01DN3ET.12.39.D06.1.454.heavy.3.raw

SEQ ID NO: 454051 - DNA, 521 bp, Homo sapiens; identical to SEQ ID NO: 445317
  misc_feature: HEFZJCU01CE4BT.12.40.D07.1.454.heavy.3.raw

SEQ ID NO: 454052 - DNA, 506 bp, Homo sapiens; identical to SEQ ID NO: 446520
  misc_feature: HEFZJCU01C3SEL.10.38.D05.1.454.heavy.3.raw

SEQ ID NO: 454053 - DNA, 517 bp, Homo sapiens
  misc_feature: HEFZJCU01BUI4P.47.78.H01.1.454.heavy.3.raw
agctcacgtacacgaccggtgctcgatttagtgtgagtagtttgggtttggggctctgggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttcctttcagtcaagtctggataagctgggtccgccaggctccagggatgggcctggagtgggttggccgtgtcaagagcagaactgatggtgcgacatctgaatacgctgcacccgtgaaaggcagattcaccatctccagagatgattcaataaatatgtcatatctacaaatggatagcctgaaaatcgaggatacaggtgtttattactgttccacagggaatgcggttctctggggccgagggac

SEQ ID NO: 454054 - DNA, 385 bp, Homo sapiens; identical to SEQ ID NO: 444438
  misc_feature: HEFZJCU01CCYWF.18.60.F05.1.454.heavy.3.raw

SEQ ID NO: 454055 - DNA, 514 bp, Homo sapiens
  misc_feature: HEFZJCU01EX2AU.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacggcagcggtcctttgactttcgtggggccaggggaccg

SEQ ID NO: 454056 - DNA, 506 bp, Homo sapiens
  misc_feature: HEFZJCU01DU88V.48.81.H04.1.454.heavy.3.raw
agtatacatacacgaccggtgctcgatttagtagtgtagattcgcgggggagcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagactgaggacacggccatttactactgtgcgcggggaggtggacggagctcggttttcggagttatcatctactacttt

SEQ ID NO: 454057 - DNA, 512 bp, Homo sapiens; identical to SEQ ID NO: 450914
  misc_feature: HEFZJCU01C5CQP.15.67.G01.1.454.heavy.3.raw

SEQ ID NO: 454058 - DNA, 526 bp, Homo sapiens
  misc_feature: HEFZJCU01BDVQX.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgacccctggggccagggaaccctggtcaccgtctcctcagcctcaaccg

SEQ ID NO: 454059 - DNA, 500 bp, Homo sapiens; identical to SEQ ID NO: 445028
  misc_feature: HEFZJCU01EAUI1.13.12.B01.1.454.heavy.3.raw

SEQ ID NO: 454060 - DNA, 503 bp, Homo sapiens
  misc_feature: HEFZJCU01CVGZT.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctggctgcctggtcaaggactactccactacta

SEQ ID NO: 454061 - DNA, 522 bp, Homo sapiens
  misc_feature: HEFZJCU01CV0DP.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcatggtcaaggactactt

SEQ ID NO: 454062 - DNA, 517 bp, Homo sapiens
  misc_feature: HEFZJCU01AK0HY.48.70.G04.1.454.heavy.3.raw
  modified_base (505)..(505): a, c, t, g, unknown or other
agtatacatacacgaccggtgctcgatttagtgtagtgtgaagggaaaggggggcctggtaccgcctggggggtcccttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttcccctggcgccctgctccaggagcacctccgagagcacagcggccctgggctgcctggtcaaggactacttcctatgtactactgtgcggcggngtcgacgacggc

SEQ ID NO: 454063 - DNA, 504 bp, Homo sapiens
  misc_feature: HEFZJCU01CQ1U5.3.23.C01.1.454.heavy.3.raw
agacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttcaatacagtgtggatgaattgggtccgccaggctccagggaaggggctggagtgggttggccatataaaagtagactgctggtgagacaacagactacgctgctgccttcagaggcagattcaccatcttcagagatgaatcacagagcactctgtttctgcaatgaacagcctggaagacgcggacacagccatgtattattgtacattaggacactatagtccctggggccagggaaccctcgtcaccgtctcctcagcctccaccaaggcccatcggtcttcccctggcgccc

SEQ ID NO: 454064 - DNA, 536 bp, Homo sapiens
  misc_feature: HEFZJCU01DI1Y6.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggagggcctttcatgtctggggccaagggacgctggtcaccgtctcttcagcctccaccaagggcccatcggtcttcccctggcaccctcctccaagagcacctctgggggcacagcc

SEQ ID NO: 454065 - DNA, 524 bp, Homo sapiens
  misc_feature: HEFZJCU01C477G.53.76.G10.1.454.heavy.3.raw
cgcgtatacacacgaccggtgctcgatttagtcactcatacaggggttgggggcaacttataaacccaaaaggaatggccatgcagcgggtagggacaatacagacagatctcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcaggcctagacatcccgggtttccccaggcctggcggtaggtttggggtgaggtctgtgtcactgtggtatgacgatttttggcgtggtttttccttcactattactcccactactacggtttggacgtctggggccaagggaccacggtcaccgtctcctcagcctccaccaagggcccatcggtcttcccctggcaccctcctccaagagcacctctgggggcacagcggccctgggctgcctggtcaaggactacttcctcgtactgcg

SEQ ID NO: 454066 - DNA, 480 bp, Homo sapiens; identical to SEQ ID NO: 446065
  misc_feature: HEFZJCU01BCUEX.15.38.D05.1.454.heavy.3.raw

SEQ ID NO: 454067 - DNA, 501 bp, Homo sapiens
  misc_feature: HEFZJCU01DJBZP.14.55.E11.1.454.heavy.3.raw
cgtctagtaccacgaccggtgctcgatttagcactcgcacgttgggctctgggagaggagcccagcactagaagtcggcggtgtttccattcggtgatcagcactgaacacagaggactcaccatggagtttgggctgagcgtgggttttccgtcgttaggctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatgggagggggtggtggatcca

SEQ ID NO: 454068 - DNA, 510 bp, Homo sapiens
  misc_feature: HEFZJCU01A76CV.3.71.G05.1.454.heavy.3.raw
agacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgtgtaaagtcccggggaaatatgtacgattttac

SEQ ID NO: 454069 - DNA, 509 bp, Homo sapiens
  misc_feature: HEFZJCU01DYU7D.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaaggcccatcggtcttcccctggcgccctgctccaggagcacctccgagagcacagcggcctggg

SEQ ID NO: 454070 - DNA, 517 bp, Homo sapiens
  misc_feature: HEFZJCU01ETN8C.22.73.G07.1.454.heavy.3.raw
acatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtccccagggaagggactggagtggattgggtatatctattacactgggagcaccgactacagcccctccctcatgagtcgagtcaccatttcactagacacgtccaagaaccagttctccctgaaactgaggtctgtgaccgctgcggacacggccgtctattactgtgcgagatttgctttttggagtggttacgccgtcgtttgactactggggccagggaaccctggtcaccgtctcctcagcctccaccaac

SEQ ID NO: 454071 - DNA, 532 bp, Homo sapiens
  misc_feature: HEFZJCU01CUM5L.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactggggccgggggaggccccgggtccgactcgtctt

SEQ ID NO: 454072 - DNA, 492 bp, Homo sapiens
  misc_feature: HEFZJCU01E0NE4.19.53.E09.1.454.heavy.3.raw
tactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttccccctggcgccctgcctccaggagcacctccgagagcacagcggccctgggctgcctggtcaaggactacttcccacgagagta

SEQ ID NO: 454073 - DNA, 504 bp, Homo sapiens
  misc_feature: HEFZJCU01A8ZHV.4.58.F03.1.454.heavy.3.raw
agcactgtagcacgaccggtgctcgatttagtctgatcgagaagggaaaggggacccaacaaccacatccctcctcagaagcccccagaacacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaagacacggctgtgtattactgttcgagacgggctagtctggggatctagttatagtgactcgtcgttctggggccac

SEQ ID NO: 454074 - DNA, 498 bp, Homo sapiens
  misc_feature: HEFZJCU01AQ45Z.17.10.A10.1.454.heavy.3.raw
  modified_base (459)..(459): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccagaacacagtctacatgcaactgacaggcctgagagctgacgacacggccgtctattactgtgcgagaatgttttcngtcatcgtacaatttgataggctctatggactggacttc

SEQ ID NO: 454075 - DNA, 390 bp, Homo sapiens; identical to SEQ ID NO: 444541
  misc_feature: HEFZJCU01DFA6E.16.24.C02.1.454.heavy.3.raw

SEQ ID NO: 454076 - DNA, 504 bp, Homo sapiens
  misc_feature: HEFZJCU01C6E9J.48.23.C01.1.454.heavy.3.raw
agtatacatacacgaccggtgctcgatttagtacacgtgattagggattggggacccaacaaccacatccctcctcagaagcccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcacaacctacactatgcattgggtgcgccaggcccccggacaaagccttgagtggatggggtggctcaacgctggcgatggtcagacaaagtattcacagaagttccagggcagagtcaccatcaccagggacacgtccgcgagtagtgtcttcatggagctgcgcagtctgagatcggaagacacggcagtatattactgtgcgagaggcggatattatcgtcgaggttgactgctacagtacaaaatcgtagtac

SEQ ID NO: 454077 - DNA, 311 bp, Homo sapiens
  misc_feature: HEFZJCU01EVTD6.40.20.B09.1.454.heavy.3.raw
tctagcgactcacgaccggtgctcgatttagtgtagtgtgaagggggggggaagaggaagactgacggtcctcccaggagttcaggtgctgggcaccttggacacgggtgtttattattgtactaaaggacaagagggactttgggagtactactacggtatggacgtctggggccaagggaccgccgtcaccgtctcctcagcttccaccaagggcccatcggtcttcccctggcgccctgctccaggagcacctctgggggcacagcggccctgggctgcctggtcaaggactacttccagtcgctaga

SEQ ID NO: 454078 - DNA, 503 bp, Homo sapiens
  misc_feature: HEFZJCU01B6BQR.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgttgcgcgacatgactacgctcaattctggggccg

SEQ ID NO: 454079 - DNA, 514 bp, Homo sapiens
  misc_feature: HEFZJCU01DAKOQ.4.75.G09.1.454.heavy.3.raw
  modified_base (343)..(343): a, c, t, g, unknown or other
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcacgcccccaggaaaggccctggagtggcttgcactcatttattgggatgatgataagcgctacagcccatctctgatgaacaggctcaccttttancaccaaggacgcctaccaaaaccaggtggtccttacaatgaccaacatcggaccctgtggacacacgccacatattactgtgcacagagagtacgggcagcacggttgggtttggggctacgtggggccacggggaaccctggtccaccgtcctcctcacgccctccaccg

SEQ ID NO: 454080 - DNA, 504 bp, Homo sapiens
  misc_feature: HEFZJCU01CLWSF.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctgggccac

SEQ ID NO: 454081 - DNA, 325 bp, Homo sapiens
  misc_feature: HEFZJCU01CF0PG.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccacttttgactattggggccagggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 454082 - DNA, 526 bp, Homo sapiens
  misc_feature: HEFZJCU01EDDOI.48.33.C11.1.454.heavy.3.raw
agtatacatacacgaccggtgctcgatttagagtgagctcgttgggtttgggtgccgaagttgctggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggcctgggctgcctggtcaaggactactcctatgtatact

SEQ ID NO: 454083 - DNA, 394 bp, Homo sapiens
  misc_feature: HEFZJCU01CMINK.49.46.E02.1.454.heavy.3.raw
agtcgagagacacgaccggtgctcgatttagactcatctacagggaaaggggcgttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 454084 - DNA, 519 bp, Homo sapiens; identical to SEQ ID NO: 453755
  misc_feature: HEFZJCU01AE4PK.9.70.G04.1.454.heavy.3.raw

SEQ ID NO: 454085 - DNA, 491 bp, Homo sapiens
  misc_feature: HEFZJCU01CO7LQ.19.53.E09.1.454.heavy.3.raw
tactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctcgcctggtcaaggactacttcccacgagagta

SEQ ID NO: 454086 - DNA, 484 bp, Homo sapiens; identical to SEQ ID NO: 445311
  misc_feature: HEFZJCU01BD307.11.23.C01.1.454.heavy.3.raw

SEQ ID NO: 454087 - DNA, 504 bp, Homo sapiens
  misc_feature: HEFZJCU01DR5P8.9.33.C11.1.454.heavy.3.raw
tgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaaggagggggatacagtggcagctccaagtactactttgacttctggggccagggaaccctggtcaccgtctcctcagcctccaccaagggcccatcagtcttcccctggcgccctgctccaggagcacctccgagagcacagcggccctgggctgcctggtcaaggactacttccagacgtatca

SEQ ID NO: 454088 - DNA, 511 bp, Homo sapiens
  misc_feature: HEFZJCU01BLI6A.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactgggccagggcaccctggtcaccgtctcctcagcttccaccaagggcccatcggtcttcccctggcgccctgctccaggagcacctctgggggcacagcggccctgggctgcctggtcaaggactacttcccatacc

SEQ ID NO: 454089 - DNA, 507 bp, Homo sapiens
  misc_feature: HEFZJCU01D5686.14.78.H01.1.454.heavy.3.raw
cgtctagtaccacgaccggtgctcgatttagtgtgagtagtttgggtttgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcatgttttagaagttggggcttttgaccactggggccagggaaccctggtcaccgtctcttcagcctccaccaagggcccatcggtcttccccctggcaccctcctccaagagcacctctgggggcacagcggccctgggctgcctggtcaaggactacttccgtactagacg

SEQ ID NO: 454090 - DNA, 396 bp, Homo sapiens; identical to SEQ ID NO: 444469
  misc_feature: HEFZJCU01A1KU2.47.46.E02.1.454.heavy.3.raw

SEQ ID NO: 454091 - DNA, 484 bp, Homo sapiens; identical to SEQ ID NO: 449584
  misc_feature: HEFZJCU01DQGNP.10.35.D02.1.454.heavy.3.raw

SEQ ID NO: 454092 - DNA, 521 bp, Homo sapiens
  misc_feature: HEFZJCU01D8DCH.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaacccgtggtcgccgtctcctcagcctccaccaagggcccatcggtcttccccctggccaccctcctccaagagcacctctgggggcacagcggccctgggctgcctggtcaaggactacttccagacgtatca

SEQ ID NO: 454093 - DNA, 396 bp, Homo sapiens; identical to SEQ ID NO: 444469
  misc_feature: HEFZJCU01CCEN7.47.46.E02.1.454.heavy.3.raw

SEQ ID NO: 454094 - DNA, 513 bp, Homo sapiens
  misc_feature: HEFZJCU01AIS5L.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaaatttggcgggctactacgagaacggattgggcgcctggggccaagggaccacggtcatcgtctccgcagcctccaccaagggcccatcggtcttccccctggcaccctcctccaagagcacctctgggggcacagcgccctgggctgcctggtcaaggactacttccgagtgcgtct

SEQ ID NO: 454095 - DNA, 526 bp, Homo sapiens; identical to SEQ ID NO: 448857
  misc_feature: HEFZJCU01AQ9SW.7.70.G04.1.454.heavy.3.raw

SEQ ID NO: 454096 - DNA, 506 bp, Homo sapiens; identical to SEQ ID NO: 444732
  misc_feature: HEFZJCU01DUXP3.14.78.H01.1.454.heavy.3.raw

SEQ ID NO: 454097 - DNA, 509 bp, Homo sapiens; identical to SEQ ID NO: 445824
  misc_feature: HEFZJCU01A1447.9.14.B03.1.454.heavy.3.raw

SEQ ID NO: 454098 - DNA, 400 bp, Homo sapiens; identical to SEQ ID NO: 447616
  misc_feature: HEFZJCU01BQATS.4.77.G11.1.454.heavy.3.raw

SEQ ID NO: 454099 - DNA, 501 bp, Homo sapiens
  misc_feature: HEFZJCU01BW1C1.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctgggggtggctacgagtactggtacttcgatctctggggccgtggcaccctgctgactgtctcctcagcctccaccaagggcccatcggtccttcccctggcgccctgcctccaggagcacctccgagagcacagcggccctgggctgcctggtcaaggactaccg

SEQ ID NO: 454100 - DNA, 506 bp, Homo sapiens; identical to SEQ ID NO: 444696
  misc_feature: HEFZJCU01C2IRS.16.34.D01.1.454.heavy.3.raw

SEQ ID NO: 454101 - DNA, 515 bp, Homo sapiens
  misc_feature: HEFZJCU01C7QLR.53.76.G10.1.454.heavy.3.raw
cgcgtatacacacgaccggtgctcgatttagtcactcatacagggggagtctccctcactgcccagctgggatctcagggcttcattttctgtcctccaccatcatggggtcaaccgccatcctcgccctcctcctggctgttctccaaggagtctgtgccgaggtgcagctggtgcagtctggaacagaggtgaaaagccgggggagtctctgaagatctcctgtaagggttctggatacaactttaccacctactggatcgcctgggtgcgccagatgcccggaaaaggcctggagtggatgggcatcgtcaatcctagtgactctgaagccacatacagcccgtccttccaaggccaggtcaccctctcagccaacaagtccatcagcgccgccttcctgcagtggcgcggcctggaggccgtcggacaccgccacatattactgtgcgagacttacatttggggggagtttagtcgttggttcctccactgggtgtctttttgattgtctc

SEQ ID NO: 454102 - DNA, 517 bp, Homo sapiens
  misc_feature: HEFZJCU01EI75E.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttattctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 454103 - DNA, 509 bp, Homo sapiens
  misc_feature: HEFZJCU01BDQHD.4.67.G01.1.454.heavy.3.raw
  modified_base (482)..(482): a, c, t, g, unknown or other
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagtttagaatgtctgccatgacctgggtccgccaggctcctgggaaggggctgggagtggatctcagggattagtggcactggcgattatacatattatacagaatccgtgaagggccgcttcaccatctccagagacaattccaagaacacggtgtatctgcaaatgaacagcctgagagccgaggacacggccacatattactgtgcgaaagntactcgggctggttccgcggtccgggt

SEQ ID NO: 454104 - DNA, 524 bp, Homo sapiens
  misc_feature: HEFZJCU01DXWWK.47.78.H01.1.454.heavy.3.raw
agctcacgtacacgaccggtgctcgatttagtgtgagtagtttgggtttggggctctctgagagtcagggacctcctgcattagcacatgaaacacctgtggttcttccgcctcctggtgacagctcccagatttgactgcctcaggaatgccgatttgaagatgtgagatgctgcctctgatcccaggactcactgcgggtttctctgttcacaggggtcctgtcccaggtgcaaccacaccactggggcgcaggactgttgaagccttcggagaccctgtccctcacctgcgctgtctgtggtgggtccttcagtgactactactgagactagatccgccagtccccagggaaggggctggaatggattcgacaggtcaatcattacagatccaccaactacaacccgtccctcagcagtcgagtcaccttttcgcttgacacgtccaacaaccagttttctctgaatcaaaaccccgagaccgccgcggacagcctcggcccctggggccccagaaacccg

SEQ ID NO: 454105 - DNA, 526 bp, Homo sapiens; identical to SEQ ID NO: 451295
  misc_feature: HEFZJCU01BJUUX.7.70.G04.1.454.heavy.3.raw

SEQ ID NO: 454106 - DNA, 474 bp, Homo sapiens
  misc_feature: HEFZJCU01BB7TQ.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactggggtgcgactggcccctggacaagggcttgagtggatgggatggatcgaccctaacagcggtggcacaaagtatgcacagaagtttcagggcaggggtcaccatgaccagggacacgtccatcagcacgtccatcagcacagcctacatggacctgagcggcctgacatctgacgacacggccgtatatttctgt

SEQ ID NO: 454107 - DNA, 496 bp, Homo sapiens
  misc_feature: HEFZJCU01A7QGM.40.81.H04.1.454.heavy.3.raw
tctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactc

SEQ ID NO: 454108 - DNA, 508 bp, Homo sapiens
  misc_feature: HEFZJCU01CMCCR.52.31.C09.1.454.heavy.3.raw
cgcagtacgacacgaccggtgctcgatttagacgtctcatcaaggaaggaaggggaagactgacggtcctcccaggagttcaggtgctgggcaccgtgggcatgggggaggcgtggtccggcctgggaggtccctgagactctcctgtgcagcctctggattcaccttcaatgtctatggcatgcactgggtccgccaggctccaggcaagggactggagtgggtggcgtttatatcatctgatggaagtaataaaactatgtagactccgtgaagggccgattcaccatctccagagacaattccaagagcactctgtatctgcaaatgaacagcctgagagctgaggacacggctatttattactgtgcgaaagatacctattactatgatgctagtgttcctacactggaccaatggggccagggaaccctggtcaccgtctcctcagcttccaccaagggcccatcggtcttcccctggccgccctgctccaggagcacctctc

SEQ ID NO: 454109 - DNA, 401 bp, Homo sapiens
  misc_feature: HEFZJCU01BY7QO.10.77.G11.1.454.heavy.3.raw
catagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcgggggggcaatggacgtctggggccaagggaccacggtcaccgtctcctcagcctccaccaagggcccatcggtcttccccctggcaccctcctccaagagcacctctggggcacagcggccctgggctgcctggtcaaggactacttcccactactatg

SEQ ID NO: 454110 - DNA, 519 bp, Homo sapiens
  misc_feature: HEFZJCU01BTUZ1.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaacgggcccatcggtccttcccctggcgccctgctccaggagcacctccgagagcacagcggcccgtgggctcg

SEQ ID NO: 454111 - DNA, 510 bp, Homo sapiens
  misc_feature: HEFZJCU01BRQ2H.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgcctgctccaggagcacctccgagagcacagcggccctgggctgcctggtcaaggactactt

SEQ ID NO: 454112 - DNA, 508 bp, Homo sapiens
  misc_feature: HEFZJCU01BYY2Z.3.55.E11.1.454.heavy.3.raw
agacgcactccacgaccggtgctcgatttagcactcgcacgttgggtttgggattcacgttgcagatgtaggtccctgagactctcctgtgcagcctctggattcaccttcagtagatatgctatgtattgggtccgtcaggctccaggcaaggggctggagtgggtggcagttatgtcacatgatggaagaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccagggaaccctggtcaccgtctcctcagcctccaccaagggcccatcggtcttcccctggccaccctcctccaagagcacctctgggggcacagcggccctgggctgcctggtcaaggactacttccgagtgcgtct

SEQ ID NO: 454113 - DNA, 512 bp, Homo sapiens; identical to SEQ ID NO: 446702
  misc_feature: HEFZJCU01C8VN4.14.25.C03.1.454.heavy.3.raw

SEQ ID NO: 454114 - DNA, 483 bp, Homo sapiens; identical to SEQ ID NO: 444924
  misc_feature: HEFZJCU01CJ9KI.10.35.D02.1.454.heavy.3.raw

SEQ ID NO: 454115 - DNA, 495 bp, Homo sapiens
  misc_feature: HEFZJCU01EICFU.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaagggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgacgaaagtagttggggaatcgaccacgtc

SEQ ID NO: 454116 - DNA, 521 bp, Homo sapiens
  misc_feature: HEFZJCU01APN56.12.71.G05.1.454.heavy.3.raw
  modified_base (463)..(463): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggacccaggtcaccgtctcctcagcctccaccaagggcccatccgtcttccccctggcgccctgctccnggagcacctccgagagcacagcggccctgggctgcctggtcaaggactacttcctacg

SEQ ID NO: 454117 - DNA, 506 bp, Homo sapiens; identical to SEQ ID NO: 446520
  misc_feature: HEFZJCU01EKDRS.10.38.D05.1.454.heavy.3.raw

SEQ ID NO: 454118 - DNA, 505 bp, Homo sapiens
  misc_feature: HEFZJCU01A8S5X.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaaacgatgcttttgatatgtggggccgaagggactacg

SEQ ID NO: 454119 - DNA, 508 bp, Homo sapiens
  misc_feature: HEFZJCU01AYF2S.40.81.H04.1.454.heavy.3.raw
tctagcgactcacgaccggtgctcgatttagtagtgtagattcgcggggacacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtaggagagacgttggtggctaccggcggggctgaccacgtggggccagggaaccctggtccaccgtcct

SEQ ID NO: 454120 - DNA, 395 bp, Homo sapiens; identical to SEQ ID NO: 444517
  misc_feature: HEFZJCU01EZT4L.16.68.G02.1.454.heavy.3.raw

SEQ ID NO: 454121 - DNA, 508 bp, Homo sapiens; identical to SEQ ID NO: 445594
  misc_feature: HEFZJCU01EX83F.17.25.C03.1.454.heavy.3.raw

SEQ ID NO: 454122 - DNA, 527 bp, Homo sapiens
  misc_feature: HEFZJCU01C2MXT.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctgggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgacccctggggccagggaaccctggtcaccgtctcctcagcctccaccg

SEQ ID NO: 454123 - DNA, 528 bp, Homo sapiens
  misc_feature: HEFZJCU01C0GWS.51.73.G07.1.454.heavy.3.raw
cgatcgtatacacgaccggtgctcgatttagctctacgctcagggcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaacgggcca

SEQ ID NO: 454124 - DNA, 538 bp, Homo sapiens
  misc_feature: HEFZJCU01CDQS0.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccacttaggtttgacttacgtgggggccaggggaagcgtttggtccaccggtcctccctcacgccctacccg

SEQ ID NO: 454125 - DNA, 516 bp, Homo sapiens; identical to SEQ ID NO: 445437
  misc_feature: HEFZJCU01C6H32.26.71.G05.1.454.heavy.3.raw

SEQ ID NO: 454126 - DNA, 509 bp, Homo sapiens
  misc_feature: HEFZJCU01C47MV.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatgctacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgcctggtcaaggactacttcctacgtcgtat

SEQ ID NO: 454127 - DNA, 496 bp, Homo sapiens
  misc_feature: HEFZJCU01D9KU3.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacgtggtttggggctacgtggggccagggaaccctggtcaccgtctcctcagcctcaccg

SEQ ID NO: 454128 - DNA, 517 bp, Homo sapiens
  misc_feature: HEFZJCU01AOZXK.48.4.A04.1.454.heavy.3.raw
agtatacatacacgaccggtgctcgatttagagtagtgatcaggggagtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgacttttggggccagggaaacctggtcaccgtctccccagcttccaccaaggcccatcggt

SEQ ID NO: 454129 - DNA, 372 bp, Homo sapiens; identical to SEQ ID NO: 444513
  misc_feature: HEFZJCU01AGCQ8.5.23.C01.1.454.heavy.3.raw

SEQ ID NO: 454130 - DNA, 526 bp, Homo sapiens
  misc_feature: HEFZJCU01EHXOI.13.38.D05.1.454.heavy.3.raw
tcacgtactacacgaccggtgctcgatttagtatctgatagttgggtttggggctgggagaggagccccagccttgggattcccaagtgttttcattcagtgatcaggactgaacacagaggactcaccatggagtttgggctgagcgtggattttcctcgctgctattttaaaaggtgtccagtgtgaggtgcaagtggtggagtctggggggggcttggttaagcctggggggtccctcagactctcctgtgcaacctctggattcattttctctgacgcctggttgagctgggtccgccaggctcccgggaagggctggagtgggttggccgtattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattactgtaccacagatgggccagatgcaatggccgcgacgagttcgactactc

SEQ ID NO: 454131 - DNA, 516 bp, Homo sapiens
  misc_feature: HEFZJCU01BBB3T.19.67.G01.1.454.heavy.3.raw
  modified_base (482)..(482): a, c, t, g, unknown or other
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctatttattgtgtgagagttttanggcgatggctgggtggacagatcactggggccac

SEQ ID NO: 454132 - DNA, 384 bp, Homo sapiens; identical to SEQ ID NO: 444454
  misc_feature: HEFZJCU01AW6EX.11.61.F06.1.454.heavy.3.raw

SEQ ID NO: 454133 - DNA, 529 bp, Homo sapiens
  misc_feature: HEFZJCU01ALN35.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctcccttgacttctggggccatggaaccccggtcc

SEQ ID NO: 454134 - DNA, 513 bp, Homo sapiens
  misc_feature: HEFZJCU01B53VZ.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 454135 - DNA, 515 bp, Homo sapiens
  misc_feature: HEFZJCU01DX2X1.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctcgtggggcacagcggcccg

SEQ ID NO: 454136 - DNA, 509 bp, Homo sapiens; identical to SEQ ID NO: 452586
  misc_feature: HEFZJCU01DP7SE.15.1.A01.1.454.heavy.3.raw

SEQ ID NO: 454137 - DNA, 481 bp, Homo sapiens; identical to SEQ ID NO: 445517
  misc_feature: HEFZJCU01C72H5.22.36.D03.1.454.heavy.3.raw

SEQ ID NO: 454138 - DNA, 508 bp, Homo sapiens
  misc_feature: HEFZJCU01AY8DA.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgcgagcgacccggggctcctcaatggctttcattacg

SEQ ID NO: 454139 - DNA, 490 bp, Homo sapiens
  misc_feature: HEFZJCU01BBJ8B.12.53.E09.1.454.heavy.3.raw
atacgacgtacacgaccggtgctcgatttagagagagtgtgttgggtttggggggtccctgagactctcctgtgcagcctctcgattcagcttcagtaactatgctatgcactgggtccgccaggctccaggcagggggctggagtgggtggcagttatatcatatgatggaagacataaatactacgcagactccgtgaagggccgattcaccctctccagagacaattccaagaatacgctgtatatgcaaatgaacagcctgagacctgaggacacggctatgtattactgtgcgagaggaccattttggaatgcttattataccggaaacgcttttgatatttggggccaagggacaatggtcaccgtctcttcagcctccaccaagggcccatcggtcttccccctcggcaccctcctccaagagcacctctgggggcacagcggccctgggctgcctggtcaaggactacttcctacgtcgtat

SEQ ID NO: 454140 - DNA, 503 bp, Homo sapiens
  misc_feature: HEFZJCU01CNFHT.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgcctcgctccaggagcacctccgagagcacagcggccctgggctgcctggtcaggactacttcccactact

SEQ ID NO: 454141 - DNA, 484 bp, Homo sapiens; identical to SEQ ID NO: 448254
  misc_feature: HEFZJCU01CK6ZP.12.75.G09.1.454.heavy.3.raw

SEQ ID NO: 454142 - DNA, 500 bp, Homo sapiens; identical to SEQ ID NO: 445807
  misc_feature: HEFZJCU01CRXM5.40.81.H04.1.454.heavy.3.raw

SEQ ID NO: 454143 - DNA, 516 bp, Homo sapiens
  misc_feature: HEFZJCU01C322N.17.33.C11.1.454.heavy.3.raw
cgtagactagcacgaccggtgctcgatttagagtgagctcgttgggtttgggggactcctgtgccccaccatggacacactttgctccacgctcctgctgatgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaaggcccatcc

SEQ ID NO: 454144 - DNA, 515 bp, Homo sapiens
  misc_feature: HEFZJCU01DC2W8.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttccccctggcgccctgctccaggagcacctctgggggcacagcc

SEQ ID NO: 454145 - DNA, 437 bp, Homo sapiens; identical to SEQ ID NO: 448878
  misc_feature: HEFZJCU01B9HL7.53.40.D07.1.454.heavy.3.raw

SEQ ID NO: 454146 - DNA, 496 bp, Homo sapiens
  misc_feature: HEFZJCU01CP90O.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctggtgtattactgtgggagagatgggaggtcggatattgta

SEQ ID NO: 454147 - DNA, 492 bp, Homo sapiens; identical to SEQ ID NO: 446787
  misc_feature: HEFZJCU01EBLU9.4.7.A07.1.454.heavy.3.raw

SEQ ID NO: 454148 - DNA, 506 bp, Homo sapiens; identical to SEQ ID NO: 448207
  misc_feature: HEFZJCU01B8OUP.53.33.C11.1.454.heavy.3.raw

SEQ ID NO: 454149 - DNA, 507 bp, Homo sapiens
  misc_feature: HEFZJCU01DHES3.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccagagcacctccgagagcacagcggccctgggctgcctggtcaaggactacttccagacgtatca

SEQ ID NO: 454150 - DNA, 499 bp, Homo sapiens
  misc_feature: HEFZJCU01B1X6L.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcagtggctttttgatgccttgatatgtgggccaagggcaatggtcacgt

SEQ ID NO: 454151 - DNA, 534 bp, Homo sapiens
  misc_feature: HEFZJCU01CHHXU.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatcccctgaaagcgtcaactactactactacggtatggacctctgggaccg

SEQ ID NO: 454152 - DNA, 513 bp, Homo sapiens
  misc_feature: HEFZJCU01BMLGF.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagcgtgggttttccgttgttaggctattttagaaggtgtccagtgtgaggtgcagctggtggagtctggggggggcttagtccagcctggggagtccctaagactctcctgtgcagcctctggattcaactttggcaagtcttggatgggctgggtccgctaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactggggccagggaccctggtcgccg

SEQ ID NO: 454153 - DNA, 512 bp, Homo sapiens
  misc_feature: HEFZJCU01AO1ZZ.4.67.G01.1.454.heavy.3.raw
agcactgtagcacgaccggtgctcgatttagagtatacatattgggtttggggtctgagagaggagcccagccctgggattttcgggtgttttcatttggtgatcaggactgaacagagagaactcaccatggagtttgggctgagcgtgcgttttcttaggtggctattttaaaaggtgtccagtgtgaagtgcagctggtggagtctgggggaggcctggcacagccgggggggtccctgagactctcctgtgcagcctctggattcagttttagaatgtctgccatgacctggtccgccaggctcctggaaggggctggagtggatctcagggattagtggcactggcgattatacatattatacagactccgtgaagggccgcttcaccatctccagagacaattccaagaacacggtgtatctgcaaatgaacagcctgagagccgaggaccacgggccacatattactgtgcgaaagatctcgggctggttccgcggtccgggatt

SEQ ID NO: 454154 - DNA, 535 bp, Homo sapiens
  misc_feature: HEFZJCU01ESA0C.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtttggatctcacttatttatagtggtggtaccacatactacacagactccgtgaagggccgattcaccatctcagaagacaattccaggaacacattgtatcttcaaatgaataacctgagagccgaggacacggccatgtattactgtgtggggctatttacttgacccctggggcccggggaacccgtggtcaccgtcctccccaccctccaccg

SEQ ID NO: 454155 - DNA, 378 bp, Homo sapiens
  misc_feature: HEFZJCU01BUAQ5.47.77.G11.1.454.heavy.3.raw
agctcacgtacacgaccggtgctcgatttagctagtcactcaagggaaagggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcgttggggccggggaacctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 454156 - DNA, 513 bp, Homo sapiens; identical to SEQ ID NO: 446452
  misc_feature: HEFZJCU01CWLG7.17.33.C11.1.454.heavy.3.raw

SEQ ID NO: 454157 - DNA, 503 bp, Homo sapiens
  misc_feature: HEFZJCU01B6I11.49.31.C09.1.454.heavy.3.raw
agtcgagagacacgaccggtgctcgatttagacgtctcatcaaggaaggaagggacctcaggggtccgggagatcatgagggtgtccctgggactctcctgtgcagcctctggattcactttcagcagctatggcatgaactgggtccgccaggctccagaaaaggggctggagtgggtctcaggtattagtggtagtggtggtatcacatcctacgtagactccgtgaagggccggttcaccatctccagagacaattccaagaacaaactttatttgcacatggaaagcctgagagccgaggacacggccatatattactgtgcgagacgtgggaactacttaggaggtgcttttgatgtctggggccaagggacaatggtcaccgtctcttcagcctccaccaagggccatcggtcttcccctggcaccctcctccaagagcacctctgggggcacagcggccctgggctgcctggtcaggactacttcctctctcgact

SEQ ID NO: 454158 - DNA, 525 bp, Homo sapiens
  misc_feature: HEFZJCU01D7CK5.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacggtatggacctc

SEQ ID NO: 454159 - DNA, 423 bp, Homo sapiens; identical to SEQ ID NO: 444772
  misc_feature: HEFZJCU01E0ZCY.16.78.H01.1.454.heavy.3.raw

SEQ ID NO: 454160 - DNA, 490 bp, Homo sapiens
  misc_feature: HEFZJCU01ELX4Q.53.68.G02.1.454.heavy.3.raw
cgcgtatacacacgaccggtgctcgatttagtcgatagtgaagggaaagggtgtacacctgagactctcctgtgcagcctctggattcacgtttgatgattctgtcatgcactgggtccggcaaactccagggaagggcctggagtggctctcaggcattacttggaatagtggcagtacaggttatgcggactctgtgaagggccgattcaccatctccagagacaacagcaaggagctcctttatttacaaatggacagcctgagagttgaggacacggccgtatattactgtgtgaaagacagcggcccacctcgcagttggtattactattacgggatggacatctggggccgagggaccacggtcaccgtctcctcagcctccaccaagggcccatcggtcttcccctggcgccctgctccaggagcacctccgagagcacagcggccctgggctgcctggtcaggactacttcctcgtactgcg

SEQ ID NO: 454161 - DNA, 499 bp, Homo sapiens
  misc_feature: HEFZJCU01DDIX1.14.55.E11.1.454.heavy.3.raw
cgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtggtgatcca

SEQ ID NO: 454162 - DNA, 519 bp, Homo sapiens; identical to SEQ ID NO: 445330
  misc_feature: HEFZJCU01D39JM.7.78.H01.1.454.heavy.3.raw

SEQ ID NO: 454163 - DNA, 501 bp, Homo sapiens; identical to SEQ ID NO: 447976
  misc_feature: HEFZJCU01CEIXI.12.38.D05.1.454.heavy.3.raw

SEQ ID NO: 454164 - DNA, 488 bp, Homo sapiens; identical to SEQ ID NO: 449258
  misc_feature: HEFZJCU01DTMHX.12.53.E09.1.454.heavy.3.raw

SEQ ID NO: 454165 - DNA, 489 bp, Homo sapiens
  misc_feature: HEFZJCU01EWO6S.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcagactacttccgtatctctcg

SEQ ID NO: 454166 - DNA, 512 bp, Homo sapiens
  misc_feature: HEFZJCU01BEUPN.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaagggcccatcggtccttccccctggc

SEQ ID NO: 454167 - DNA, 518 bp, Homo sapiens
  misc_feature: HEFZJCU01DB4KU.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactgggccagggaaccctggtcaccgtctcctcagcctccaccaagggcccatcggtcttcccctggccaccctcctccaagagcacctctgggggcacagcggccctgggctgcctggtcaaggactacttcctagagacacg

SEQ ID NO: 454168 - DNA, 511 bp, Homo sapiens
  misc_feature: HEFZJCU01CTLJH.2.16.B05.1.454.heavy.3.raw
  modified_base (502)..(502): a, c, t, g, unknown or other
acgctcgacacacgaccggtgctcgatttagagctcacgtattgggtttgaggtctcagagaggagccttagccctggactccaaggcctttccacttggtgatcagcactgagcacagaggactcaccatggaattggggctgagcgtggtttcgtgtaggccatttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaaggaactcactgtatctgcaaatgaacagcctaagacccgaggacacggctgtgtattactgtgcgagagaccgctacgtggggcccgggancccgtgggt

SEQ ID NO: 454169 - DNA, 511 bp, Homo sapiens
  misc_feature: HEFZJCU01EMXFF.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttcttagtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactacgtggggccg

SEQ ID NO: 454170 - DNA, 484 bp, Homo sapiens
  misc_feature: HEFZJCU01DET2I.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctcaaaaaatgaacagcctgagagccgaggacacggccgtgtattactgtgtgagagataagtccgggtatcacttggatagaagtgcttattacattgactactgggccagggaaccctcgtcaccgtctcctcagcctccaccaagggcccatcggtcttcccctggccaccctcctccaagagcacctctgggggcacagcggccctgggctgcctggtcaaggactacttcctagagacacg

SEQ ID NO: 454171 - DNA, 457 bp, Homo sapiens
  misc_feature: HEFZJCU01BK0YW.15.28.C06.1.454.heavy.3.raw
tctacgtagccacgaccggtgctcgatttagagctcacgtattgggtttgggggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggcccatcggtcttcccctggcgccctgctccaggagcacctccgagagcacagcggcctgggctgcctggtcaaggactacttccgctacgtaga

SEQ ID NO: 454172 - DNA, 494 bp, Homo sapiens
  misc_feature: HEFZJCU01EWTXH.53.25.C03.1.454.heavy.3.raw
cgcgtatacacacgaccggtgctcgatttagtagtgtagatttgggtttgggggggtccctgagactctcctgtgcagcctctggattcaccttcagtatttatagcatgaattggatccgccaggctccagggaaggggctcgagtgggtctcatccattagtagtagtagtagttacaaatactacgcagactcagtgaagggccgattcaccgtctccagagacaacgccaagaactcactgtatctgcaaatgaatagcctgagagccgaggacacggctgtatatttctgtgcgagagatgacccatataacagtgactactactctgtggatgatgcttttgatgtctggggccaagggacaatagtcaccgtctcttcagcctccaccaagggcccatcggtcttcccctggcaccctcctccaagagcacctctgggggcacagcggccctggctgcctggtcaaggactacttcctcgtactgcg

SEQ ID NO: 454173 - DNA, 513 bp, Homo sapiens
  misc_feature: HEFZJCU01ETOLN.49.26.C04.1.454.heavy.3.raw
agtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaaggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattaacggtgaccacacctattttgaccactc

SEQ ID NO: 454174 - DNA, 515 bp, Homo sapiens; identical to SEQ ID NO: 447834
  misc_feature: HEFZJCU01CMCEW.3.20.B09.1.454.heavy.3.raw

SEQ ID NO: 454175 - DNA, 461 bp, Homo sapiens
  misc_feature: HEFZJCU01DBX7B.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaattggggccaggaaccctggtctccgtctcgtcagcctccaccaagggcccatcggtcttcccctggcgccctgctccaggagcacctccgagagcacagcggccctgggctgcctggtcaaggactacttcccagagagta

SEQ ID NO: 454176 - DNA, 509 bp, Homo sapiens
  misc_feature: HEFZJCU01EQSAB.48.81.H04.1.454.heavy.3.raw
agtatacatacacgaccggtgctcgatttagtagtgtagattcgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggtttcggagttatcatctactactttgtaac

SEQ ID NO: 454177 - DNA, 505 bp, Homo sapiens
  misc_feature: HEFZJCU01CGSNO.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagtttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactcgctcaattctggggccagggacg

SEQ ID NO: 454178 - DNA, 515 bp, Homo sapiens
  misc_feature: HEFZJCU01C40SM.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttacagtggcggcactacatactacacagacttcgcgaggggccgattcaccatctccagagacgattccaagaacacgttgtatcttcaaatgaacagcctgacagtcgacgacacggccatgtatttttgtgcgagcgacccggggctcctcaatggctttcattactggggccagggtaa

SEQ ID NO: 454179 - DNA, 502 bp, Homo sapiens
  misc_feature: HEFZJCU01C91AN.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttcccctggcaccctcctccaagagcacctctggggcacagcggccctgggctgcctggtcaaggactacttccgagtagtaca

SEQ ID NO: 454180 - DNA, 510 bp, Homo sapiens; identical to SEQ ID NO: 448445
  misc_feature: HEFZJCU01EV8SX.16.71.G05.1.454.heavy.3.raw

SEQ ID NO: 454181 - DNA, 454 bp, Homo sapiens; identical to SEQ ID NO: 447777
  misc_feature: HEFZJCU01C2KMW.40.35.D02.1.454.heavy.3.raw

SEQ ID NO: 454182 - DNA, 430 bp, Homo sapiens; identical to SEQ ID NO: 444675
  misc_feature: HEFZJCU01BZ7B9.40.34.D01.1.454.heavy.3.raw

SEQ ID NO: 454183 - DNA, 501 bp, Homo sapiens
  misc_feature: HEFZJCU01BFQX9.10.38.D05.1.454.heavy.3.raw
catagtagtgcacgaccggtgctcgatttagtatctgatagttgggtttgggtgccgaagttgctggaggtcacggtcaccacgctgctgagggagtagggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggccctgggctgcctggtcaaggactacttcccactact

SEQ ID NO: 454184 - DNA, 499 bp, Homo sapiens
  misc_feature: HEFZJCU01D0JYU.12.55.E11.1.454.heavy.3.raw
atacgacgtacacgaccggtgctcgatttagcactcgcacgttgggtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgcctgctc

SEQ ID NO: 454185 - DNA, 313 bp, Homo sapiens; identical to SEQ ID NO: 445488
  misc_feature: HEFZJCU01C789Q.49.8.A08.1.454.heavy.3.raw

SEQ ID NO: 454186 - DNA, 531 bp, Homo sapiens
  misc_feature: HEFZJCU01C4T4Q.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaagggctggtgtgggtctcacatattaatctcgatgggagtaatttagcctacgcggactccgtcaagggccgattcaccgtctccagagacaacaccaagaacacactatatctgcagattgacagtctgagacccgaggacacgggctgtgtattactgtgcaaggcagttcgtggaaacagttatggttggggggagttggggtttttttttcgtacttacgggatc

SEQ ID NO: 454187 - DNA, 509 bp, Homo sapiens; identical to SEQ ID NO: 447652
  misc_feature: HEFZJCU01DZ4N0.4.33.C11.1.454.heavy.3.raw

SEQ ID NO: 454188 - DNA, 530 bp, Homo sapiens
  misc_feature: HEFZJCU01BVVMS.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagcgtgggttttccttgttgctatttcaaagggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccgtggggccggggaaccctggtcaccgtctccccaccctccaccg

SEQ ID NO: 454189 - DNA, 519 bp, Homo sapiens
  misc_feature: HEFZJCU01DQVDF.5.23.C01.1.454.heavy.3.raw
atcagacacgcacgaccggtgctcgatttagtacacgtgattaggggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaagaggctggagtggattggggagatctatcgataccgggagcaccgaactacaatccgtccctcaagagtcgagtcaccatatctatagacacgtcgaacaaccagttctccctgaaggtgacctctgtgaccgccgcggacacggccgtctattactgtgcgcggatttcagagggacagggactactatatcgacgtctggggcagagggaccacggtcatcgtctcctcagcctcccg

SEQ ID NO: 454190 - DNA, 320 bp, Homo sapiens
  misc_feature: HEFZJCU01DUGH0.52.20.B09.1.454.heavy.3.raw
cgcagtacgacacgaccggtgctcgatttagtgtagtgtgaagggccgattcaccatttccagagacagctccgataacacggtctatctgcgaatgaacagcctgagacctgaggacacggctcttttttactgtgcgccaggaagcagtggctggccacatgatgcttttgatatctggagccaagggacaatggtcatcgtctcttcggcctccaccaagggcccatcggtcttccccctggcaccctcctccaagagcacctctggggcacagcggccctgggctgcctggtcaaggactacttcctatacgatcg

SEQ ID NO: 454191 - DNA, 500 bp, Homo sapiens
  misc_feature: HEFZJCU01A43RJ.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagtatttctatagaggtgacgtacgggggcgttcg

SEQ ID NO: 454192 - DNA, 496 bp, Homo sapiens; identical to SEQ ID NO: 446600
  misc_feature: HEFZJCU01EQVVV.4.21.B10.1.454.heavy.3.raw

SEQ ID NO: 454193 - DNA, 474 bp, Homo sapiens
  misc_feature: HEFZJCU01AR0V2.3.39.D06.1.454.heavy.3.raw
agacgcactccacgaccggtgctcgatttagtgacatctcgcagttctttgggttttggggggtccctgagactctcatgtacaggctctgagttcagcgtcactaaatactacatgagctgggtccgccaggctccagggaggggactggactgggtctccagtgttaacagcgatggaagtacatattatgcagactccgtgaagggccgattcaccatctccagagacaattccaagaacactctgtatcttcaaatgaacagcctgagagccgaggacacggccttctattactgtgcgagcgatcacgggcggagtctgatactttcttggggccagggaaccctggtcaccgtctcctcagcctccaccaagggcccatcgtcttcccctggcgccctgctccaggagcacctccgagagcacagcggccctgggctgcctggtcaaggactacttccgagtgcgtct

SEQ ID NO: 454194 - DNA, 399 bp, Homo sapiens; identical to SEQ ID NO: 444537
  misc_feature: HEFZJCU01B3L6Y.16.29.C07.1.454.heavy.3.raw

SEQ ID NO: 454195 - DNA, 510 bp, Homo sapiens
  misc_feature: HEFZJCU01DZQV7.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgtcatgaactgggtccgccaggctccagggaagggctggagtgggtaggtttcattagagccatggcttatgctgggacaacagaatacgccgcgtctgtgaaggcagattcatcatctcaagagatgattccaacggcatcgcctatctgcagatagacagcctgaagaccgaggacacagccgtctattactgtggttagggtagttttacgtatttttggt

SEQ ID NO: 454196 - DNA, 509 bp, Homo sapiens; identical to SEQ ID NO: 445225
  misc_feature: HEFZJCU01EHH6Z.9.78.H01.1.454.heavy.3.raw

SEQ ID NO: 454197 - DNA, 518 bp, Homo sapiens
  misc_feature: HEFZJCU01DADI2.10.87.H10.1.454.heavy.3.raw
catagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtctgggggaggcgtggtccagcctggggggtccctgagactctcctgtgcagcctctggattcgacttcgaaatgtctggcatgcactgggtccgccaggctccaacgaaggggctggagtgggtggcagttcttcatttgatgaaaaagggaatattatgcgacctccgtgaagggccgattcagcatctccagagacatttccaaggccacggtgtatctgcaaatgaccagcctgagaagtgaggacacggctatgtactattgtgcgaaggaccttccacctgaaactaatatggggggctttggaacacgtc

SEQ ID NO: 454198 - DNA, 506 bp, Homo sapiens
  misc_feature: HEFZJCU01CM65R.22.11.A11.1.454.heavy.3.raw
acatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaattccaagccgcgggggtcacccaattgactactc

SEQ ID NO: 454199 - DNA, 426 bp, Homo sapiens; identical to SEQ ID NO: 444564
  misc_feature: HEFZJCU01BVCS6.9.34.D01.1.454.heavy.3.raw

SEQ ID NO: 454200 - DNA, 527 bp, Homo sapiens
  misc_feature: HEFZJCU01BG1UX.12.40.D07.1.454.heavy.3.raw
  modified_base (495)..(495): a, c, t, g, unknown or other
atacgacgtacacgaccggtgctcgatttagtgatagagcgtaacaacagagggctcaccatggagtttgggctgagcgtgggttttccgtcgttaggctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttggttctgggggccaggggaccctggtcatcgtctccccagccnccaccaagggcccatcggtcttcccctggccg

SEQ ID NO: 454201 - DNA, 481 bp, Homo sapiens; identical to SEQ ID NO: 445517
  misc_feature: HEFZJCU01DE7DG.22.36.D03.1.454.heavy.3.raw

SEQ ID NO: 454202 - DNA, 372 bp, Homo sapiens
  misc_feature: HEFZJCU01EP3SK.49.70.G04.1.454.heavy.3.raw
agtcgagagacacgaccggtgctcgatttagtgtagtgtgaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 454203 - DNA, 396 bp, Homo sapiens; identical to SEQ ID NO: 444426
  misc_feature: HEFZJCU01A9LR2.18.31.C09.1.454.heavy.3.raw

SEQ ID NO: 454204 - DNA, 487 bp, Homo sapiens; identical to SEQ ID NO: 452507
  misc_feature: HEFZJCU01DKS02.51.52.E08.1.454.heavy.3.raw

SEQ ID NO: 454205 - DNA, 520 bp, Homo sapiens; identical to SEQ ID NO: 453029
  misc_feature: HEFZJCU01BZD2H.16.86.H09.1.454.heavy.3.raw

SEQ ID NO: 454206 - DNA, 515 bp, Homo sapiens
  misc_feature: HEFZJCU01EV7PO.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattaccaagaacacactgtatctgacaatgaacagcctgagagccgacgacacggccatatattactgtgacgaaagcaccggctagttagtcacccatacttactttcgactacgtggggacc

SEQ ID NO: 454207 - DNA, 395 bp, Homo sapiens; identical to SEQ ID NO: 444517
  misc_feature: HEFZJCU01BZNMH.16.68.G02.1.454.heavy.3.raw

SEQ ID NO: 454208 - DNA, 527 bp, Homo sapiens
  misc_feature: HEFZJCU01ECKIJ.4.35.D02.1.454.heavy.3.raw
agcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaagggaagggactggagtgggttggatatatctttcacaccgggaccaccaactacaatccctccctcaagagtcgactcaccatgtcactggacacttccaagaaccagttctccctaaaattgacctctgtgagcgctgcagacacggccgtctattactgtgcgagactgcggggctattattgggttcgggagatcccagttggtttttgattatattgggggccaggggacaggcggtcaccggtctcttcagcct

SEQ ID NO: 454209 - DNA, 514 bp, Homo sapiens; identical to SEQ ID NO: 448304
  misc_feature: HEFZJCU01CL4R4.26.12.B01.1.454.heavy.3.raw

SEQ ID NO: 454210 - DNA, 499 bp, Homo sapiens
  misc_feature: HEFZJCU01C1BZO.12.55.E11.1.454.heavy.3.raw
atacgacgtacacgaccggtgctcgatttagcactcgcacgttgggttttcctcgttgctcttttaagaggtgtccagtgtcagatgcagctggtggagtctggggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgacctttctggtatttcgatctctggggccgtggcaccctggtcactgtctcctcggcttccaccaagggcccatcggtcttcccctggcgcctgctcagagcacctctggggc

SEQ ID NO: 454211 - DNA, 385 bp, Homo sapiens
  misc_feature: HEFZJCU01DFFI2.48.78.H01.1.454.heavy.3.raw
agtatacatacacgaccggtgctcgatttagtgtgagtagtttgggtttgggcaccgtgggcatgtgtgagttgtgtcaccaagtggggtttgacttctccttggccacctctgtcagcacggcatatctgcagatcagcagcctaaagcctgaggacactgccgtgttttattgtgcgagatccaggcgaggaggataccgattcttatatagcgactactactacttcggaatggacgtctggggccaggggaccacggtcaccgtctcctcagcttccaccaagggcccatcggtcttccccctggcgccctgctccaggagcacctctgggggcacagcggccctgggctgcctggtcaaggactacttcctatgtatact

SEQ ID NO: 454212 - DNA, 508 bp, Homo sapiens
  misc_feature: HEFZJCU01BGP8G.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaagggcccatcggtcttcccctggcgccctgctccaggagcacctctgggggcacagcggccctgggctgcctggtcaggactactcccata

SEQ ID NO: 454213 - DNA, 513 bp, Homo sapiens; identical to SEQ ID NO: 454134
  misc_feature: HEFZJCU01B2H9S.16.21.B10.1.454.heavy.3.raw

SEQ ID NO: 454214 - DNA, 533 bp, Homo sapiens
  misc_feature: HEFZJCU01CAWP7.48.10.A10.1.454.heavy.3.raw
agtatacatacacgaccggtgctcgatttagcgtcgatctcaggggactctgggagaggagccccagccctgagattcccaggtgtttccattcagcgatcagcactgaacacagaggactcaccatggacttgggactgagcgtggagttttcctttaggctcttttaaaaggtgccagtgtgaagtacaactggtggagtctgggggaggcttggtgcagcctggcaggtccctgagactctcctgtgcagcctccggattcacctttgagaattttgccatgaactgggtccggcgacttccagagaagggcctggagtggtcgcaatgattagtcgaagcaccaaaagtgtaggatatggggactctgtaaagggccgattcaccgtgtccagagacaacgccaaaaattccctgtttcttgaaatgaacagtctgagacctgaggacacggccctatatttttgtacaaaagaccggagcagtggggggaatggtggcagctcctcgggcttttgattcttgggccga

SEQ ID NO: 454215 - DNA, 523 bp, Homo sapiens
  misc_feature: HEFZJCU01A70W1.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagtacggttttgattatttggggccaaggggacaaggggtcaccgtctccgcagcctccaccg

SEQ ID NO: 454216 - DNA, 529 bp, Homo sapiens
  misc_feature: HEFZJCU01CNRJK.49.27.C05.1.454.heavy.3.raw
agtcgagagacacgaccggtgctcgatttagacgcgatcgaagggtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaaccctggtcaccgtctcctcagcctccaccaagggcccatcggtcttcccctggcgccctgctccaggagcacctccgagagcacagcggcccg

SEQ ID NO: 454217 - DNA, 500 bp, Homo sapiens; identical to SEQ ID NO: 445720
  misc_feature: HEFZJCU01A73HK.3.20.B09.1.454.heavy.3.raw

SEQ ID NO: 454218 - DNA, 497 bp, Homo sapiens
  misc_feature: HEFZJCU01CT7WU.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctgggggtgctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaaggactacg

SEQ ID NO: 454219 - DNA, 438 bp, Homo sapiens
  misc_feature: HEFZJCU01A53L2.48.39.D06.1.454.heavy.3.raw
agtatacatacacgaccggtgctcgatttagtgacatctcgcagttctttgggttttggggggaagaggaagactgacggtccccccaggagttcaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttcctatgtatact

SEQ ID NO: 454220 - DNA, 446 bp, Homo sapiens
  misc_feature: HEFZJCU01ES30D.51.35.D02.1.454.heavy.3.raw
cgatcgtatacacgaccggtgctcgatttagcacacgatagttgggtttgggtagttgggtttggggggaagaggaagactgacggtccccccaggagttcaggtgctggactgggtggcaggcatatcatttgatggaagcaagaagtactatgcagactccgtgaagggccgattcaccatctccagagacagttccgatgacacagtctatctacacatgagcagtgtgagacctgacgacacggctcttttttactgtgcgccaggaagcagtggctggccacatcatgcttttgatatctggagccaagggacaatggtcatcgtctcttggcctccaccaagggcccatcggtcttccccctggcaccctcctccaagagcacctctgggggcacagcggccctgggctgcctggtcaaggactacttcctcgtagcact

SEQ ID NO: 454221 - DNA, 393 bp, Homo sapiens
  misc_feature: HEFZJCU01CDDTY.18.1.A01.1.454.heavy.3.raw
tacgagtatgcacgaccggtgctcgatttagacgtctcatcaaggaagggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaagagcacctctgggggcacagcggccctgggctgcctggtcaaggactaccatactcgta

SEQ ID NO: 454222 - DNA, 519 bp, Homo sapiens
  misc_feature: HEFZJCU01C4AD0.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccgaagggaccacggtcatcgtctccccacgcctccaccaagggcccatcggtcttccccctggcgccctgcctccacggagcaccc

SEQ ID NO: 454223 - DNA, 494 bp, Homo sapiens
  misc_feature: HEFZJCU01C05LH.4.19.B08.1.454.heavy.3.raw
  modified_base (452)..(452): a, c, t, g, unknown or other
agcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggaggcgtggtccagcctgggaggtccctgagactctcctgtatagcctctggattcaccttcggcagttatgctatgcactgggtccgccaggctccaggcaaggggttggagtgggtggcagcaatatcatatgatggaagtgataaatattacatagagtccgtgaagggtcgattcaccatctccagagacaatcgcaagaacacactgtatctgaaatgaccagcctgagagtgacgacacgggtntttatactgtgcgcgggatagaggctcatcgtggatacaact

SEQ ID NO: 454224 - DNA, 512 bp, Homo sapiens
  misc_feature: HEFZJCU01DQFJQ.10.53.E09.1.454.heavy.3.raw
catagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccggattcaccatctccaaagacaatttgaagaacacgctgtttctgcaaatgaacagcctgagagctgaggacacggctgtgtattactgttcgtttggttctgactcgtcgggggaataccttc

SEQ ID NO: 454225 - DNA, 500 bp, Homo sapiens; identical to SEQ ID NO: 446033
  misc_feature: HEFZJCU01CY2AG.11.27.C05.1.454.heavy.3.raw

SEQ ID NO: 454226 - DNA, 499 bp, Homo sapiens
  misc_feature: HEFZJCU01BUD0A.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctcttttattactgtgcgagagtctgggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaaggactacc

SEQ ID NO: 454227 - DNA, 502 bp, Homo sapiens; identical to SEQ ID NO: 451203
  misc_feature: HEFZJCU01AI0GW.10.38.D05.1.454.heavy.3.raw

SEQ ID NO: 454228 - DNA, 529 bp, Homo sapiens
  misc_feature: HEFZJCU01C2FGM.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgaccccgtgggggccaggggaaccctggtcaccgtctcctcagcctccaccg

SEQ ID NO: 454229 - DNA, 514 bp, Homo sapiens
  misc_feature: HEFZJCU01B5C39.17.33.C11.1.454.heavy.3.raw
  modified_base (504)..(504): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaacccaggtggtccttacaatgaccaatatggaccctgtggacacagccacatattactgttcacgctctatggttcggggagttattagtccctactttgactactggggccagggaactctggtcaccgtctccgcagcctccnccaagggccc

SEQ ID NO: 454230 - DNA, 506 bp, Homo sapiens; identical to SEQ ID NO: 444696
  misc_feature: HEFZJCU01B7D1O.16.34.D01.1.454.heavy.3.raw

SEQ ID NO: 454231 - DNA, 483 bp, Homo sapiens; identical to SEQ ID NO: 444924
  misc_feature: HEFZJCU01BT1F7.10.35.D02.1.454.heavy.3.raw

SEQ ID NO: 454232 - DNA, 519 bp, Homo sapiens
  misc_feature: HEFZJCU01EZJ9Q.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctgcaccctcctccaagagcacctctgggggcacagcggccctgggctgcctggtcaaggactaccttcctagagacacg

SEQ ID NO: 454233 - DNA, 500 bp, Homo sapiens; identical to SEQ ID NO: 447017
  misc_feature: HEFZJCU01BVJTF.13.12.B01.1.454.heavy.3.raw

SEQ ID NO: 454234 - DNA, 507 bp, Homo sapiens
  misc_feature: HEFZJCU01CZ1QR.26.37.D04.1.454.heavy.3.raw
  modified_base (445)..(445): a, c, t, g, unknown or other
  modified_base (487)..(487): a, c, t, g, unknown or other
agactatactcacgaccggtgctcgatttagtagcatactgttgggtttggggagctctgggagaggagcccagcactggaagtcgccggtgtttccattcggtgatcagcactgaacacagaggactcaccatggagtttgggctgagcgtgggttttccgtcgttaggctcttttaagaggtgtccagtgtcaggagcaggtagtggagtctgggggaggcgtggtccagcctggggggtccctgagactctcctgtgcagcctctggattcaccttcagtacctacgccatgcactggatccgccaggctccaggcaaggggctagagtgggtggctcttatatcatatgatggaagtaatgaacattacgcagactccgtgaagggccgattcaccgtctccagagacaattccaagagcacgatgtttctgcaaatgaanagcctgagagttgaggacacgggtgtctatttctgtgcgcgngtccgggtgaggggtgtcca

SEQ ID NO: 454235 - DNA, 505 bp, Homo sapiens
  misc_feature: HEFZJCU01AQ8PQ.40.55.E11.1.454.heavy.3.raw
tctagcgactcacgaccggtgctcgatttagcactcgcacgttgggtttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtctttttgatgcctttgatatgtggggccaagggacaatggtcaccgt

SEQ ID NO: 454236 - DNA, 515 bp, Homo sapiens
  misc_feature: HEFZJCU01ANHFV.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtggggccgggggaaccctggtcaccgtctcttcagcctccaccaaggcccatcggtcttcccctggcaccctcctccaagagcacctctgggggcac

SEQ ID NO: 454237 - DNA, 509 bp, Homo sapiens
  misc_feature: HEFZJCU01D64NP.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctgggggggggcgtggtccagcctgggaggtccctgagactctcctgtgcaggctctggattcaccttcagtaactacggcgtgcactgtgtccgccaggctccaggcaagggcttggagtggctggcagttgtttcatctgaaggaagtgttcaatactatacagactccgtgaagggccgattcaccatctccagagacaattccaagaacacgatgtatctgcaatggacagcctaagagttgaggacacggctgtttattacttgtacgaaaggaaggggggagtacgagtggcgagctccaagta

SEQ ID NO: 454238 - DNA, 512 bp, Homo sapiens
  misc_feature: HEFZJCU01B0AS7.10.87.H10.1.454.heavy.3.raw
catagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtctgggggaggcgtggtccagcctggggggtccctgagactctcctgtgcagcctctggattcgacttcgaaatgtctggcatgcactgggtccgccaggctccaacgaaggggctggagtgggtggcagttctttcatttgatgaaaaagggatattatgcgacctccgtgaagggccgattcagcatctccagagacatttccaaggccacggtgtatctgcaatgaccagcctgagaagtgaggacacggctatgtactattgtgcgaaggaccttccacctgaaactatatgggggctttgacactc

SEQ ID NO: 454239 - DNA, 499 bp, Homo sapiens; identical to SEQ ID NO: 452982
  misc_feature: HEFZJCU01EZWSP.11.71.G05.1.454.heavy.3.raw

SEQ ID NO: 454240 - DNA, 521 bp, Homo sapiens
  misc_feature: HEFZJCU01CN8PA.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgagggggccgattcaccatctccagagacaattacaagaacaccctttatctgcaaatagacagcctgagaccagacgacacggctgtctattattgcgcgagagagacacacgaacctactggccaatactatgggggcttgtctggggccaggggaccctggtcatcgtctccccagcctccaccaagggcccatcggtcttcccctggcg

SEQ ID NO: 454241 - DNA, 485 bp, Homo sapiens
  misc_feature: HEFZJCU01AZX2H.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggccacggtcaccgtctcctcggcctccaccaagggccatcggtcttcccctggcgccctgctccaggagcacctccgagagcacagcggccctgggctgcctggtcaggactacttccatactcgta

SEQ ID NO: 454242 - DNA, 503 bp, Homo sapiens
  misc_feature: HEFZJCU01DSP11.14.12.B01.1.454.heavy.3.raw
cgtctagtaccacgaccggtgctcgatttagtagtgtagatttgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaagggcccatcggtcttcccctggccaccctcctcc

SEQ ID NO: 454243 - DNA, 536 bp, Homo sapiens
  misc_feature: HEFZJCU01EM7RV.14.26.C04.1.454.heavy.3.raw
cgtctagtaccacgaccggtgctcgatttagtctagcgactttgggtttgggggtctcagagaggagccttagccctggactccaaggcctttccacttggtgatcagcactgagcacagaggactcaccatggagttggggctgagctgggttttccttgttgctattttagaaggtgtccagtgtgaggtgcagttggtggactctgggggaggcttggtccagcctggggggtccctgagactctcctgtgcagcctctggattcacctttagtaaatattggatgatgtgggtccgccaggctccagggaaggggctggagtgggtggcccacataaacgaagacggaattaagaaatactatctggactctgtgaagggccgattcaccatctccagagacaacgccgagaactcactgtatctgcagatgaacagcctgagagccgaagacacggccgtgtattactgtacgagagacgttagggtttaaaacttttgactattgggccagggaaccctggtcaccgtct

SEQ ID NO: 454244 - DNA, 395 bp, Homo sapiens; identical to SEQ ID NO: 444517
  misc_feature: HEFZJCU01BI2WR.16.68.G02.1.454.heavy.3.raw

SEQ ID NO: 454245 - DNA, 396 bp, Homo sapiens; identical to SEQ ID NO: 444469
  misc_feature: HEFZJCU01DJCMX.47.46.E02.1.454.heavy.3.raw

SEQ ID NO: 454246 - DNA, 496 bp, Homo sapiens
  misc_feature: HEFZJCU01CDNKQ.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccctttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 454247 - DNA, 511 bp, Homo sapiens
  misc_feature: HEFZJCU01DVCSH.49.34.D01.1.454.heavy.3.raw
agtcgagagacacgaccggtgctcgatttagatcgtctgtgttgggtttgggggaggcgtggtccagcctgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaaccccgtccgcacggtacggacgtctggggccaagggaccacggtcaccgtctcctcagcctccaccaagggcccatcggtcttcccctcggcaccctcctccaagagcacctctgggggcacagcggccctgggctgcctggtcaggactacttcctctctcgact

SEQ ID NO: 454248 - DNA, 509 bp, Homo sapiens
  misc_feature: HEFZJCU01A55PN.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccgattcaccatctccagagacaattccaagaacacgatgtatctgcaaatggacagacctaagagttgaggacacggctgtttattactgtacgaaaggaggggggatacgagtggcagctccaagtacttac

SEQ ID NO: 454249 - DNA, 525 bp, Homo sapiens; identical to SEQ ID NO: 453584
  misc_feature: HEFZJCU01BOPVA.47.6.A06.1.454.heavy.3.raw

SEQ ID NO: 454250 - DNA, 478 bp, Homo sapiens; identical to SEQ ID NO: 448105
  misc_feature: HEFZJCU01DNOL0.26.78.H01.1.454.heavy.3.raw

SEQ ID NO: 454251 - DNA, 535 bp, Homo sapiens
  misc_feature: HEFZJCU01CYFZR.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactacgtgggccagggaaccctggtcaccgtctcctcacgcctccaccaacggg

SEQ ID NO: 454252 - DNA, 500 bp, Homo sapiens; identical to SEQ ID NO: 445720
  misc_feature: HEFZJCU01AW74E.3.20.B09.1.454.heavy.3.raw

SEQ ID NO: 454253 - DNA, 517 bp, Homo sapiens
  misc_feature: HEFZJCU01ERH3T.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctaactacggtctggacgtctggggccaggggacc

SEQ ID NO: 454254 - DNA, 510 bp, Homo sapiens
  misc_feature: HEFZJCU01A0F7A.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaagggctggagtgggtggccagcatgaacggagatggaagtcaaaagactatgtggactctgtgaagggccgattcaccatctccagagacaacgccaagaactcactgtatctgcaaatgaacagcctaagacccgaggacacggctgtgtattactgtgcgagagaccgctacgtgggggcccgggagcccctggt

SEQ ID NO: 454255 - DNA, 480 bp, Homo sapiens
  misc_feature: HEFZJCU01DHUAK.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaaggccatcggtctcccctggcgccctgctccaggagcacctccgagagcacagcggccctgggctgcctggtcaaggactacttcccactactatg

SEQ ID NO: 454256 - DNA, 499 bp, Homo sapiens
  misc_feature: HEFZJCU01CD48V.48.73.G07.1.454.heavy.3.raw
agtatacatacacgaccggtgctcgatttagctctacgctcagggggctttctgagagtcatggatctcatgtgcaagaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggccaagggacaagtggtcaccgtcgtt

SEQ ID NO: 454257 - DNA, 521 bp, Homo sapiens
  misc_feature: HEFZJCU01B5AWV.12.40.D07.1.454.heavy.3.raw
atacgacgtacacgaccggtgctcgatttagtgatagagcgtaacaacagagggctcaccatggagtttgggctgagcggtggtttcgtcgtaggcgtctttaagtaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggcagggaccctggtcatcgtctccccagcctccaccaagggcccatcggtcttcccctggcg

SEQ ID NO: 454258 - DNA, 522 bp, Homo sapiens
  misc_feature: HEFZJCU01B6B35.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggggccgggaaccctggtcgccgtctcctcagcctccaccaagggcccatcggtcttcccctggcaccctccctccaagagcacctcgtgggggcacagccggccctgggctgcctggtcgaaggactacttccagacgtatca

SEQ ID NO: 454259 - DNA, 430 bp, Homo sapiens; identical to SEQ ID NO: 450689
  misc_feature: HEFZJCU01EAY3O.40.34.D01.1.454.heavy.3.raw

SEQ ID NO: 454260 - DNA, 505 bp, Homo sapiens; identical to SEQ ID NO: 445664
  misc_feature: HEFZJCU01DOUUF.12.33.C11.1.454.heavy.3.raw

SEQ ID NO: 454261 - DNA, 480 bp, Homo sapiens; identical to SEQ ID NO: 445011
  misc_feature: HEFZJCU01CXLX6.22.36.D03.1.454.heavy.3.raw

SEQ ID NO: 454262 - DNA, 491 bp, Homo sapiens; identical to SEQ ID NO: 447981
  misc_feature: HEFZJCU01BFA2G.47.85.H08.1.454.heavy.3.raw

SEQ ID NO: 454263 - DNA, 525 bp, Homo sapiens
  misc_feature: HEFZJCU01DP38L.12.71.G05.1.454.heavy.3.raw
  modified_base (488)..(488): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagccctgagatttgacggacacggccatgtatttactgtgcgagggagggccagctgctgggagcgtctacatatttcgacccctggggccagggaacccaggtcaccgtctcctcagcctccaccaagggcccatccgtcttccccctggcgccctgctccaggagcacctccgagagcacancggccctgggctgcctggtcaaggactacttcctacg

SEQ ID NO: 454264 - DNA, 388 bp, Homo sapiens
  misc_feature: HEFZJCU01B6GUQ.51.2.A02.1.454.heavy.3.raw
cgatcgtatacacgaccggtgctcgatttagactcatctacagggcaaggggctggagtgggtggcagttatatcatatgatggaaagaataaatactatggagactccgtgaagggccgattcaccatctctagagacaatctcaaggagacagtgcatctgcaaatgaacagcctgagaggtgacgacacggctgtgtattactgtcacctcgagagcagcaattggagagaggtttttgatatctggggccaagggactatggtcaccgtctcttcagcctccaccaagggcccatcggtcttccccctggcaccctcctccaagagcacctctgggggcacagcggcctgggctgcctggtcaaggactactcctcgtagcact

SEQ ID NO: 454265 - DNA, 536 bp, Homo sapiens
  misc_feature: HEFZJCU01A6U3N.49.86.H09.1.454.heavy.3.raw
agtcgagagacacgaccggtgctcgatttagtgctatagacttgggtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagactttatgacagtagtggtttctccgagtatgcacattacggcatggacgtctggggccaaggggaccccggtcaccgtctccttagcctccaccaagggcccatcggtcttcccctggccaccctcctccaagagcacctctc

SEQ ID NO: 454266 - DNA, 510 bp, Homo sapiens
  misc_feature: HEFZJCU01C3AKJ.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccattcatcatctccagagacaacgccgacaactcactgtctctgctgatgagcagcctgagagccgacgacacggctatctattactgtgcgaaactctcattccgttcatctgaatactggggccagggaaccctggtcgtccg

SEQ ID NO: 454267 - DNA, 519 bp, Homo sapiens; identical to SEQ ID NO: 445330
  misc_feature: HEFZJCU01CVPHI.7.78.H01.1.454.heavy.3.raw

SEQ ID NO: 454268 - DNA, 506 bp, Homo sapiens
  misc_feature: HEFZJCU01DE926.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccaggggacg

SEQ ID NO: 454269 - DNA, 487 bp, Homo sapiens; identical to SEQ ID NO: 445077
  misc_feature: HEFZJCU01EEJAQ.47.85.H08.1.454.heavy.3.raw

SEQ ID NO: 454270 - DNA, 487 bp, Homo sapiens
  misc_feature: HEFZJCU01EE6UV.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggagcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattattgtgcccttgatttacta

SEQ ID NO: 454271 - DNA, 520 bp, Homo sapiens
  misc_feature: HEFZJCU01DTSVU.53.58.F03.1.454.heavy.3.raw
cgcgtatacacacgaccggtgctcgatttagtctgatcgagaagggaaaggggatactttctgagagtcctggacctcctgtgcaagaacatgaaacatctgtggttcttccttctcctggtggcagctcccagatgggtcctgtcccaggtgcagctgcaggagtcgggcccaggactggtgaagccttcggagaccctgtccctcacctgcactgtctctgttggctccatcattcattatttctggagctgggtccggcagcccccagggaagggactggagtggattgggtatgtctattacaccgggaccacccactacaacccctccctcaagagtcgagtcaccatatcagtagacacgtccaggaaccagttctccctgaagctgagctctgcgaccgctgcggacacggccgtgtattattgtgcgagagttagatttgatactggtgcagccgtacgggggtcctggttcgacccctggggccatggaaccctggtcaccgtctcctcag

SEQ ID NO: 454272 - DNA, 477 bp, Homo sapiens; identical to SEQ ID NO: 453049
  misc_feature: HEFZJCU01CJQK0.40.37.D04.1.454.heavy.3.raw

SEQ ID NO: 454273 - DNA, 512 bp, Homo sapiens
  misc_feature: HEFZJCU01AIJM4.52.1.A01.1.454.heavy.3.raw
cgcagtacgacacgaccggtgctcgatttagacgtctcatcagggggctttctgagagtcatggacctcctgtgcaagaacatgaagcacctgtggtttttcctcctgctggtggcagctcccagatgggtcctgtcccacgtgcagctgcgggagtcgggcccaggactggtgaagccttcggagatcatgtccctcacctgctctgtctctggtgactccatcagcagtggttattactgggcctgggtccggcagcccccagggaaggggtttgagtggattgggagtatcgatcacagtgggagcacctacctgaacccgtccctcacgactcgagtcgccatatcaacagacacgtccaagaaccagttctacctgaggctgaactctgtgaccgccgcagacacggccgtatattattgtgcgcgggacttcgaggggtggatatagtggctacgattcgtatctccttgactactggggccagggaccctggtcaccgtctcctc

SEQ ID NO: 454274 - DNA, 509 bp, Homo sapiens; identical to SEQ ID NO: 447939
  misc_feature: HEFZJCU01CANY6.17.25.C03.1.454.heavy.3.raw

SEQ ID NO: 454275 - DNA, 496 bp, Homo sapiens
  misc_feature: HEFZJCU01EPHFV.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctgggccgtggcacctggtcactgtctcctcggcttccaccaggcccatcggtcttcccctgcgcctgctcagagcacctctggggcac

SEQ ID NO: 454276 - DNA, 513 bp, Homo sapiens
  misc_feature: HEFZJCU01A38SC.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcacttttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacgactgtctattactgtgcgagagggcgtccgagtttaacacgccgtcgggagggatattactttgacaactggggccagggaaccctggtcaccgtctcctcagcctccaccaagggcccatcggtcttccccctggcgccctgctccaggagcacctccgagagcacagcggccctgggctgcctggtcaaggactactt

SEQ ID NO: 454277 - DNA, 427 bp, Homo sapiens; identical to SEQ ID NO: 444708
  misc_feature: HEFZJCU01DH098.9.34.D01.1.454.heavy.3.raw

SEQ ID NO: 454278 - DNA, 507 bp, Homo sapiens
  misc_feature: HEFZJCU01EL5JT.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggctttgacttctggggccagggacg

SEQ ID NO: 454279 - DNA, 529 bp, Homo sapiens
  misc_feature: HEFZJCU01DM33G.17.34.D01.1.454.heavy.3.raw
cgtagactagcacgaccggtgctcgatttagatcgtctgtgttgggtttggggatcacaaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtcctatcgttgacacaccaaactacgcacagaagttccagggcagactcaccataaccgcggacaattaacgaacacagttaatctggagctgaacagcctgtcatctgaggacacgggcttctacttctgtgcgaggagtaattactataacactgctccttttacacctcccttgacttctggggtccatcggaaccccggtcc

SEQ ID NO: 454280 - DNA, 481 bp, Homo sapiens; identical to SEQ ID NO: 453118
  misc_feature: HEFZJCU01ELJOD.7.10.A10.1.454.heavy.3.raw

SEQ ID NO: 454281 - DNA, 525 bp, Homo sapiens; identical to SEQ ID NO: 451902
  misc_feature: HEFZJCU01BGF3W.16.27.C05.1.454.heavy.3.raw
  modified_base (518)..(518): a, c, t, g, unknown or other

SEQ ID NO: 454282 - DNA, 552 bp, Homo sapiens
  misc_feature: HEFZJCU01A76OC.18.14.B03.1.454.heavy.3.raw
tacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtggattacatttgggggagttatcgcaaacgggggggtactactacgctatggacgtctggggccaagggaccacggtcaccgtctcctcagcctccaccaagggcccatcggtcttcccctggccaccctcctccaagagcacctctgggggcacg

SEQ ID NO: 454283 - DNA, 375 bp, Homo sapiens; identical to SEQ ID NO: 444442
  misc_feature: HEFZJCU01BP9P4.48.23.C01.1.454.heavy.3.raw

SEQ ID NO: 454284 - DNA, 480 bp, Homo sapiens; identical to SEQ ID NO: 444657
  misc_feature: HEFZJCU01A702U.19.67.G01.1.454.heavy.3.raw

SEQ ID NO: 454285 - DNA, 518 bp, Homo sapiens
  misc_feature: HEFZJCU01CF5XY.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacaagccacatattactgttcacgctctatggttcggggagttattagtccctactttgactactggggccagggaactctggtcaccgtctccgcagcctccaccaagggcccatcc

SEQ ID NO: 454286 - DNA, 526 bp, Homo sapiens
  misc_feature: HEFZJCU01C7UMC.4.66.F11.1.454.heavy.3.raw
agcactgtagcacgaccggtgctcgatttagtcacgcgagaagggggggagaggagccccagccttgggattcccaagtgttttcattcagtgatcaggactgaacacagaggactcaccatggagtttgggctgagcgtggattttccttactgctattttaaaaggtgtccagtgtgaggtgaaactggtggagtctgggggaggcttgataaagcctggggggtcccttagactctcctgtgcagcctctggattcaccttcagtgacgactggatgaattggatccgccaggctccagggaaggggctggagtgggtcggccatattaagcccaaaactgaacgtgggaaacagactacgctgcacccgtgagaggcagattcaccatttcaagagatgattcaaaaagtacactgtatctggaaatgaacagcctgagaatcgacgacacagccgtttattactgcagaagagggcactatggtccctggggccagggaaccctggtccaccgtctcctca

SEQ ID NO: 454287 - DNA, 492 bp, Homo sapiens
  misc_feature: HEFZJCU01DAXH4.51.81.H04.1.454.heavy.3.raw
cgatcgtatacacgaccggtgctcgatttagtagtgtagattcgcgggggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatcctccagagacaactcgaagaatacggttcttctacaaatgaacagcctgagagctgaggacacggctattgttttactgtgcgagagggaactcgattacagcag

SEQ ID NO: 454288 - DNA, 508 bp, Homo sapiens; identical to SEQ ID NO: 446002
  misc_feature: HEFZJCU01CIDI3.9.78.H01.1.454.heavy.3.raw

SEQ ID NO: 454289 - DNA, 496 bp, Homo sapiens; identical to SEQ ID NO: 444697
  misc_feature: HEFZJCU01DN6J9.16.37.D04.1.454.heavy.3.raw

SEQ ID NO: 454290 - DNA, 498 bp, Homo sapiens
  misc_feature: HEFZJCU01CU8XH.47.56.F01.1.454.heavy.3.raw
  modified_base (435)..(435): a, c, t, g, unknown or other
agctcacgtacacgaccggtgctcgatttagcagacgtctgaacacacaaagggggccccagccctgggattcccagctgtttctgcttgctgatcaggactgcacacagagaactcaccatggagtttgggctgagcgtggtttcgtgtaggctatttaaagtgtccagtgtgaggtgcaactggtggagtccgggggaggcttaattcagcctggggggtccctgagactctcctgtgcagcctctggattcaccttcagtagttactggatgcactgggtccgccaagctccagggaagggactggtgtgggtctcacgtattaatcctgatggaagtcgcacaaactacgcggactccgtgagggaccgattcaccatcctccagagacaacgccaagaacacgctgtatctgcaaatgcacagtctgagngccgacgatgcggctgtatatttctgttgcaagagaatcaactggtgggaccgcttttatttc

SEQ ID NO: 454291 - DNA, 529 bp, Homo sapiens
  misc_feature: HEFZJCU01C2EPJ.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaa

SEQ ID NO: 454292 - DNA, 520 bp, Homo sapiens
  misc_feature: HEFZJCU01CE1D1.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatgacagcctgagaccagacgacacggctgtctattattgcgcgagagagacacacgaacctactggccaatactatgggggcttgttctgggggccaggggaccctggtcatcgtctccccagcctccaccaagggcccatcggtctcccctggcg

SEQ ID NO: 454293 - DNA, 496 bp, Homo sapiens
  misc_feature: HEFZJCU01DEJQT.22.86.H09.1.454.heavy.3.raw
acatacgcgtcacgaccggtgctcgatttagtgctatagacttgggtttgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccctggcgccctgctccaggagcacctccgagagcacagcggccctgggctgcctggtcaggactacttccacgcgtatgt

SEQ ID NO: 454294 - DNA, 390 bp, Homo sapiens; identical to SEQ ID NO: 448683
  misc_feature: HEFZJCU01B1MQG.11.25.C03.1.454.heavy.3.raw

SEQ ID NO: 454295 - DNA, 520 bp, Homo sapiens; identical to SEQ ID NO: 447654
  misc_feature: HEFZJCU01BGMZ0.10.79.H02.1.454.heavy.3.raw

SEQ ID NO: 454296 - DNA, 511 bp, Homo sapiens
  misc_feature: HEFZJCU01D0E2O.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtcccccaacacagggactgcagtggattggatacatctacttcagtgggaaccccaactacaacccctcctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaagggcccatcggtcttcccctcggc

SEQ ID NO: 454297 - DNA, 495 bp, Homo sapiens
  misc_feature: HEFZJCU01CUK0F.40.81.H04.1.454.heavy.3.raw
tctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctgggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactc

SEQ ID NO: 454298 - DNA, 536 bp, Homo sapiens
  misc_feature: HEFZJCU01EQ7PI.14.57.F02.1.454.heavy.3.raw
  modified_base (385)..(385): a, c, t, g, unknown or other
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgngtgaaagatacgaagtctatgatacccaatttgggaggggctttcatgtctggggcaagggacgctggtcaccgtctcttcagcctccaccaagggcccatcggtcttcccctggccaccctcctccaagagcacctctgggggcacagcc

SEQ ID NO: 454299 - DNA, 527 bp, Homo sapiens; identical to SEQ ID NO: 446775
  misc_feature: HEFZJCU01C7NPL.9.78.H01.1.454.heavy.3.raw

SEQ ID NO: 454300 - DNA, 496 bp, Homo sapiens; identical to SEQ ID NO: 444697
  misc_feature: HEFZJCU01BTL2J.16.37.D04.1.454.heavy.3.raw

SEQ ID NO: 454301 - DNA, 526 bp, Homo sapiens
  misc_feature: HEFZJCU01CEVYE.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactatacactgctccttttacacctcccttgacttctggggccatggaaccccggtc

SEQ ID NO: 454302 - DNA, 500 bp, Homo sapiens
  misc_feature: HEFZJCU01C7XE3.49.5.A05.1.454.heavy.3.raw
agtcgagagacacgaccggtgctcgatttagatagatagacaggggagctctgagagaggagcccagccctgggattttcaggtgttttcatttggtgatcaggactgagcagagagaactcaccatggagtttgggctgagcgtggcgttttcttagtggctattttaaaaggtgtccagtgtgaggtgcagctggtggactctgggggaggcttggtacagcctggggggtccctgagactctcctgtgcagcctctggattcacctttagcagttttgccatgggctgggtccgccaggctccagggaaggggctggagtgggtctcaactattagcggtattggtactaccacatactacgcagactccgtgaagggccgcttcaccatctccagagacaattccaagaacatggtgttctgcaaatgagcagcctgagagccgagacacggccgtatatctgtgcgaaagttcgcgtgctaggtacatttgaact

SEQ ID NO: 454303 - DNA, 494 bp, Homo sapiens
  misc_feature: HEFZJCU01CDCYI.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctggggcacagcggccctggctgcctggtcag

SEQ ID NO: 454304 - DNA, 508 bp, Homo sapiens
  misc_feature: HEFZJCU01EMNPS.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaaagtgacgtggtattccggggggtacacaatgacaccg

SEQ ID NO: 454305 - DNA, 523 bp, Homo sapiens
  misc_feature: HEFZJCU01EAWCX.9.63.F08.1.454.heavy.3.raw
tgatacgtctcacgaccggtgctcgatttagcgatcgtataagggttgagtccagcccagccacacggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttccccctggcaccctcctccaagagcacctctgggggcacacg

SEQ ID NO: 454306 - DNA, 503 bp, Homo sapiens
  misc_feature: HEFZJCU01AQOEP.48.59.F04.1.454.heavy.3.raw
agtatacatacacgaccggtgctcgatttagtacacacacttagggattgggggctttctgagagtcatggatctcatgtgcaagaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgccagacacggctgtctattactgtgcgaggccccgagcgcagtggctttttgatgcctttgatatgtgggccaagggacaatggtcaccgt

SEQ ID NO: 454307 - DNA, 423 bp, Homo sapiens; identical to SEQ ID NO: 444772
  misc_feature: HEFZJCU01BRUMN.16.78.H01.1.454.heavy.3.raw

SEQ ID NO: 454308 - DNA, 494 bp, Homo sapiens
  misc_feature: HEFZJCU01AV9LD.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggcctggcaccctggtcactgtctcctcggcttccaccaagggccatcggtcttcccctggcgccctcgctccaggagcacctctgggggcacagcggccctggctgcctggtcaggactacttcctacgtcgtat

SEQ ID NO: 454309 - DNA, 414 bp, Homo sapiens; identical to SEQ ID NO: 444982
  misc_feature: HEFZJCU01BO5CL.5.23.C01.1.454.heavy.3.raw

SEQ ID NO: 454310 - DNA, 507 bp, Homo sapiens
  misc_feature: HEFZJCU01BB22J.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccaggggaaccctggtcatcgtctcctcagcctccaccaagggcccatcggtcttcccctggcaccctcctccaagagcacctctgggggcacagcggccctgggctgcctggtcaaggactacttccgagtagtaca

SEQ ID NO: 454311 - DNA, 512 bp, Homo sapiens
  misc_feature: HEFZJCU01CHB96.14.23.C01.1.454.heavy.3.raw
cgtctagtaccacgaccggtgctcgatttagtacacgtgattagggattggggccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcactttcagcacctatgctatcaactgggtgcgacaggcccctggacaagggcttgagtggatgggaggaatcatccctatgtttggtacaactaactacacacagaagttccagggcagagtcacgattaccgcggacgaatccacgagcacagcctacatggagctgagcagcctgagatctgacgacacggccgtgtattactgtgcgagggccttcgggtttcgttcagtgccgtggttgtagaactggggccgagggaacgtctggtcgaccgtcctcctccagcctccacccg

SEQ ID NO: 454312 - DNA, 542 bp, Homo sapiens
  misc_feature: HEFZJCU01B2ACZ.13.57.F02.1.454.heavy.3.raw
tcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttgggtccgccagcccccagggaaggggctggagtggattggggaaatctttcatagcgggatcaccaactacaacccgtccctcaagagtcgagtcaccatatctatagacaagtccaagaaccacttctccctgaacgtgagttctgtgaccgccgcggacacggccgtgtattactgtgcgagaggattgtggttttactctggttcaatgagttattatgtctttgactattggggccagggaaccctggtcaccgtctcctcagcctccaccaaggg

SEQ ID NO: 454313 - DNA, 514 bp, Homo sapiens
  misc_feature: HEFZJCU01CPYLC.10.59.F04.1.454.heavy.3.raw
catagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggctccatcaacagtggtgacaactggtggggctgggtccgccagcccccagggatgggactggagtggattgggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaatgtactttgaccactggggccagggagccctggtcaccgtctcctcacg

SEQ ID NO: 454314 - DNA, 396 bp, Homo sapiens; identical to SEQ ID NO: 444426
  misc_feature: HEFZJCU01BLA9H.18.31.C09.1.454.heavy.3.raw

SEQ ID NO: 454315 - DNA, 400 bp, Homo sapiens; identical to SEQ ID NO: 444452
  misc_feature: HEFZJCU01E2EJ5.47.24.C02.1.454.heavy.3.raw

SEQ ID NO: 454316 - DNA, 520 bp, Homo sapiens
  misc_feature: HEFZJCU01EO0NE.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcggagggggccggatattgttatacgaaccacctgctatctgagctggttcgacgtgcgtggggccaacggggaaccctggtcctacccg

SEQ ID NO: 454317 - DNA, 498 bp, Homo sapiens
  misc_feature: HEFZJCU01ERRX4.4.19.B08.1.454.heavy.3.raw
agcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggaggcgtggtccagcctgggaggtccctgagactctcctgtatagcctctggattcaccttcggcagttatgctatgcactgggtccgccaggctccaggcaaggggttggagtgggtggcagcaatatcatatgatggaagtgataaatattacatagagtccgtgaagggtcgattcaccatctccagagacaatcgcaagaacacactgtatctggaaatgaccagcctgagaggtgacgacacgggtgtttattactgtgcgcgggatagaggctcatcgtggatacaactt

SEQ ID NO: 454318 - DNA, 480 bp, Homo sapiens
  misc_feature: HEFZJCU01D8V6C.9.36.D03.1.454.heavy.3.raw
tgatacgtctcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctggtcaaggactacttccagacgtatca

SEQ ID NO: 454319 - DNA, 500 bp, Homo sapiens; identical to SEQ ID NO: 446033
  misc_feature: HEFZJCU01DGYJQ.11.27.C05.1.454.heavy.3.raw

SEQ ID NO: 454320 - DNA, 506 bp, Homo sapiens
  misc_feature: HEFZJCU01B273U.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccaggaaggggctggagtggattgggagtatttaccacagtgggagcacctactacaacccgtccctcaaaagtcgaggcaccatatccgtagacacgtccaagaaccaattctccctgaagctgagctctgtgaccgccgccagacacggctgtctattactgtgcgaggccccgagcgcagtggctttttgatgcctttgatatgtggggccaaggggacaagtggtcaccgt

SEQ ID NO: 454321 - DNA, 386 bp, Homo sapiens
  misc_feature: HEFZJCU01DDMU6.10.60.F05.1.454.heavy.3.raw
catagtagtgcacgaccggtgctcgatttagtacgtcatcagggaaagggcctggagtgggtctcaggtattacttggaatggtggtataataggctatgcggactctgtgaggggccgcttcaccatctccaaggacagcgccaagagatccctctatctgcaaatgaacagtctgagaactgaggacacggcctactactactgtgcaaaagatgattccggcagttacttcttagataactggggccggggaaccctggtcgccgtctcttcagcctccaccaagggcccatcggtcttccccctggcgccctgctccaggagcacctccgagagcacagcggccctgggctgcctggtcaaggactacttcccactactatg

SEQ ID NO: 454322 - DNA, 546 bp, Homo sapiens
  misc_feature: HEFZJCU01EOQ39.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctgggaccagggaaccctggtcatcgtctcctcagcctccaccaagggcccatcggtcttcccctggccgccctgctccaggacgcaccctccgagacgcacacgccggcccctcggggccgttcggcccgttcgggtccgaaacggggaaccctttaaccgtttcccttaaccggttcggaacggtccttccgttggac

SEQ ID NO: 454323 - DNA, 541 bp, Homo sapiens
  misc_feature: HEFZJCU01A4IZI.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggattttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggctggatcggggagtttggttcctggggccaggggaaccctggtccg

SEQ ID NO: 454324 - DNA, 518 bp, Homo sapiens
  misc_feature: HEFZJCU01D812M.9.34.D01.1.454.heavy.3.raw
tgatacgtctcacgaccggtgctcgatttagatcgtctgtgttggggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgatacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggcctgggctgcctggtcaaggactacttccagacgtatca

SEQ ID NO: 454325 - DNA, 505 bp, Homo sapiens; identical to SEQ ID NO: 447076
  misc_feature: HEFZJCU01EZDQO.10.38.D05.1.454.heavy.3.raw

SEQ ID NO: 454326 - DNA, 517 bp, Homo sapiens
  misc_feature: HEFZJCU01AU6ID.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagatggggccacgaacgttactacgctatggacgtctggggccaagggaccg

SEQ ID NO: 454327 - DNA, 500 bp, Homo sapiens; identical to SEQ ID NO: 444529
  misc_feature: HEFZJCU01C2QHS.12.38.D05.1.454.heavy.3.raw

SEQ ID NO: 454328 - DNA, 500 bp, Homo sapiens
  misc_feature: HEFZJCU01EAWNY.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacaacggccgtttattattgtgcaataagaattgcaacgatgcttttgatatgtggggaccg

SEQ ID NO: 454329 - DNA, 490 bp, Homo sapiens
  misc_feature: HEFZJCU01EVVHH.47.85.H08.1.454.heavy.3.raw
  modified_base (488)..(488): a, c, t, g, unknown or other
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagcgtggtttcgtcgttagctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtcatctgcacctgaccagcctgagaactgacgacacgtctctctactactgtgcgagagagttgacgngt

SEQ ID NO: 454330 - DNA, 506 bp, Homo sapiens
  misc_feature: HEFZJCU01CN8RM.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgtcgcgagagacgtaaagtagacgtggtagttcggggggacacatgacacc

SEQ ID NO: 454331 - DNA, 511 bp, Homo sapiens
  misc_feature: HEFZJCU01BTMNH.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgcgttttcttaggtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaaggggccggagtgggtgtcagtcattagtagtagtggtgatagaatttaccacacagactccgtgaagggccgcttcaccatctctagagacaattcccagaacacactgtatctgcaaatgactaggctgagagccgacgacacggccatttattactgcgcgaaggatatacgggtcgacaacggtggctacgcgttt

SEQ ID NO: 454332 - DNA, 382 bp, Homo sapiens; identical to SEQ ID NO: 450938
  misc_feature: HEFZJCU01EW5U1.9.80.H03.1.454.heavy.3.raw

SEQ ID NO: 454333 - DNA, 509 bp, Homo sapiens
  misc_feature: HEFZJCU01CXBB3.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcccagagctgaggacgacgacgtcgtgtagttacttacgtgtggaacgaagtttactttactagta

SEQ ID NO: 454334 - DNA, 511 bp, Homo sapiens
  misc_feature: HEFZJCU01D3S8P.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctacgtgggggcccgggagccctggt

SEQ ID NO: 454335 - DNA, 493 bp, Homo sapiens
  misc_feature: HEFZJCU01AC3MQ.10.29.C07.1.454.heavy.3.raw
catagtagtgcacgaccggtgctcgatttagagtgctacgaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccccgagactctcctgtgcagcctctggaatccccttcagtacctatggcatgcactgggtccgccaggctccaggcaaggggctggagtgggtggcagccatatcgtatgatgtaactaataaatactatgcagactccgtgaagggccgattcaccatctccagagacaatttcaagaacacgctgttctgcaaatgaacagcctgagagctgaggacacggctgtgtattactgtgcgaaagatatcgcggtgacta

SEQ ID NO: 454336 - DNA, 512 bp, Homo sapiens
  misc_feature: HEFZJCU01CVZNJ.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagccctgagatttgacgacacggccatatattactgtgcgagagattgggccgacggaaaccttgactactggggccagggaaccctggtcaccgt

SEQ ID NO: 454337 - DNA, 510 bp, Homo sapiens
  misc_feature: HEFZJCU01EYG5B.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctgggccagggaaccctggtcaccgtctcctcagcctccaccaagggcccatcggtcttcccctggcaccctcctccaagagcacctctgggggcacagcggccctgggctgcctggtcaaggactactccgtactacg

SEQ ID NO: 454338 - DNA, 517 bp, Homo sapiens; identical to SEQ ID NO: 449396
  misc_feature: HEFZJCU01CCXI2.11.13.B02.1.454.heavy.3.raw

SEQ ID NO: 454339 - DNA, 476 bp, Homo sapiens; identical to SEQ ID NO: 452095
  misc_feature: HEFZJCU01B26TJ.16.10.A10.1.454.heavy.3.raw

SEQ ID NO: 454340 - DNA, 489 bp, Homo sapiens; identical to SEQ ID NO: 444791
  misc_feature: HEFZJCU01DO8KO.47.85.H08.1.454.heavy.3.raw

SEQ ID NO: 454341 - DNA, 507 bp, Homo sapiens; identical to SEQ ID NO: 446637
  misc_feature: HEFZJCU01E090S.16.34.D01.1.454.heavy.3.raw

SEQ ID NO: 454342 - DNA, 437 bp, Homo sapiens; identical to SEQ ID NO: 444603
  misc_feature: HEFZJCU01ELFCP.3.21.B10.1.454.heavy.3.raw

SEQ ID NO: 454343 - DNA, 515 bp, Homo sapiens
  misc_feature: HEFZJCU01C2L7D.48.24.C02.1.454.heavy.3.raw
agtatacatacacgaccggtgctcgatttagtacagatcgttagggaaaggggtctgagagaggagcccagccctgggattctcaggtgttttcatttggtgatcaggactgaacagagagaactcaccatggagtttgggctgagcgtggcttttcttagtggctattttaaaaggtgtccagtgtgaggtgcacctgttggagtctgggggaggcttggtacagcctggggggtccctgagactctcctgtgcagcctctggattcacctttagcagctatgccatgagctgggtccgccaggctccagggacggggctggagtgggtctcagctattagtggtagtggtggtggcacatactacgcagactccgtgaagggccggttcaccatctccagagacaattccaagaacacactttatctgcgaatgaacagcctgagagccgaggacacggccgtatattactgtgcgaaagaagtcagggttactatgatatcgggaggatttg

SEQ ID NO: 454344 - DNA, 499 bp, Homo sapiens
  misc_feature: HEFZJCU01B5K4R.40.81.H04.1.454.heavy.3.raw
tctagcgactcacgaccggtgctcgatttagtagtgtagattcgcgggggcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccac

SEQ ID NO: 454345 - DNA, 506 bp, Homo sapiens; identical to SEQ ID NO: 444696
  misc_feature: HEFZJCU01DNDST.16.34.D01.1.454.heavy.3.raw

SEQ ID NO: 454346 - DNA, 503 bp, Homo sapiens
  misc_feature: HEFZJCU01EDC51.47.81.H04.1.454.heavy.3.raw
agctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttccttgttgctatattagaaggtgtccagtgtgaggtgcagctggtggagtcggggggaggcctggtacagcctggggggtccctgagactctcctgtgcagcctctggattcatcttcagtgactacgacatgcactgggtccgccaagttgcaggagaacctctggaatgggtctccgttattgctactggtggtgccacagactatgcaggctccgtgaggggccgattcaccatctccagagaaaatggcaagaactccttgtatcttcaaatgaacagcctgagagccggggacacggcggtgtattactgtgtaagagagctcgatggtaacaggggactaat

SEQ ID NO: 454347 - DNA, 480 bp, Homo sapiens; identical to SEQ ID NO: 446171
  misc_feature: HEFZJCU01DHT8G.22.36.D03.1.454.heavy.3.raw

SEQ ID NO: 454348 - DNA, 496 bp, Homo sapiens
  misc_feature: HEFZJCU01C79QH.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacacgcctgagagctgaggacacggctgtgtattacgtgtgggagagatgggaggtcgatattgta

SEQ ID NO: 454349 - DNA, 522 bp, Homo sapiens
  misc_feature: HEFZJCU01BBDHJ.48.81.H04.1.454.heavy.3.raw
agtatacatacacgaccggtgctcgatttagtagtgtagattcgcgggaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggagttatcatctactactttgaatcttggggcccgggaacctggtcaccg

SEQ ID NO: 454350 - DNA, 515 bp, Homo sapiens
  misc_feature: HEFZJCU01CC9OG.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgtttactacgctatggacgtctggggccg

SEQ ID NO: 454351 - DNA, 530 bp, Homo sapiens
  misc_feature: HEFZJCU01CSJZG.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaagggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtaatggctgtgtttattggggccagggagcctggtcaccggt

SEQ ID NO: 454352 - DNA, 495 bp, Homo sapiens
  misc_feature: HEFZJCU01DCC8P.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctcccgagagcacagcggccctggctgcctggtcaaggactacttccctacagtgct

SEQ ID NO: 454353 - DNA, 513 bp, Homo sapiens; identical to SEQ ID NO: 446452
  misc_feature: HEFZJCU01AJJS9.17.33.C11.1.454.heavy.3.raw

SEQ ID NO: 454354 - DNA, 488 bp, Homo sapiens; identical to SEQ ID NO: 447495
  misc_feature: HEFZJCU01ESGJM.22.86.H09.1.454.heavy.3.raw

SEQ ID NO: 454355 - DNA, 483 bp, Homo sapiens
  misc_feature: HEFZJCU01CZ3QC.49.9.A09.1.454.heavy.3.raw
agtcgagagacacgaccggtgctcgatttagcgagacgcgcaggggtgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagcaatatatactatgtagactccgtgaagggccgattcatcatctccagagacaattccgagaacacgctgtatctgcaaatgaacagcctgagagctgaggacacggctgtgtattactgtgcgaactttaatcacgga

SEQ ID NO: 454356 - DNA, 396 bp, Homo sapiens; identical to SEQ ID NO: 444469
  misc_feature: HEFZJCU01CM67T.47.46.E02.1.454.heavy.3.raw

SEQ ID NO: 454357 - DNA, 506 bp, Homo sapiens; identical to SEQ ID NO: 444674
  misc_feature: HEFZJCU01BFNP4.12.33.C11.1.454.heavy.3.raw

SEQ ID NO: 454358 - DNA, 505 bp, Homo sapiens
  misc_feature: HEFZJCU01D5J7H.11.57.F02.1.454.heavy.3.raw
cgagagataccacgaccggtgctcgatttagctcgatatagttgggtttgggggcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgccaggctccaggtaagggctggaatggatttcatacattagcagtagtggtgcgaccatatactacgcagactctgtgaagggccgattcatcatctccagagacaatggcaacaactcactgtatctggaaatcaacagcctgagagtcgaggacacgg

SEQ ID NO: 454359 - DNA, 532 bp, Homo sapiens
  misc_feature: HEFZJCU01DLIXP.11.10.A10.1.454.heavy.3.raw
cgagagataccacgaccggtgctcgatttagcgtcgatctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactactacatggacgtctggggcaaagggaccacggtcaccgtctcctcagcctccaccaagggcccatcggtcttcccctggcaccctcctccaagagcacctctgggggcacagcggccctggctgcctggtcaaggactacttccgtatctctcg

SEQ ID NO: 454360 - DNA, 502 bp, Homo sapiens
  misc_feature: HEFZJCU01BHA37.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccatatatttctgtgcgcgaggaatttcgacttctggaatattacttgggttggaactacctt

SEQ ID NO: 454361 - DNA, 524 bp, Homo sapiens
  misc_feature: HEFZJCU01AUQ0E.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctcccttgacttctgggccatggacccggt

SEQ ID NO: 454362 - DNA, 495 bp, Homo sapiens
  misc_feature: HEFZJCU01D1N92.51.38.D05.1.454.heavy.3.raw
cgatcgtatacacgaccggtgctcgatttagtatctgatagttgggtttggggctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctaatctacacatgagcagtgtgagacctgacgacacggctctttttactgttgcgccaggaagcagtggctgg

SEQ ID NO: 454363 - DNA, 383 bp, Homo sapiens
  misc_feature: HEFZJCU01C310V.22.46.E02.1.454.heavy.3.raw
acatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttccccctggcgccctgctccaggagcacctccgagagcacagcggccctgggctgcctggtcaaggactacttccacgcgtatgt

SEQ ID NO: 454364 - DNA, 529 bp, Homo sapiens
  misc_feature: HEFZJCU01DIAV0.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccagggaagggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtcgtggggccaagggacctacc

SEQ ID NO: 454365 - DNA, 484 bp, Homo sapiens; identical to SEQ ID NO: 448254
  misc_feature: HEFZJCU01AYYYJ.12.75.G09.1.454.heavy.3.raw

SEQ ID NO: 454366 - DNA, 513 bp, Homo sapiens
  misc_feature: HEFZJCU01B7NXJ.11.13.B02.1.454.heavy.3.raw
cgagagataccacgaccggtgctcgatttagtctagcgactttgggttctccttgttgctattttagaaggtgtccagtgtgaggcgcagatggtggggtctggggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtccttcccctggcgccctgctccaggagcacctccgagagcacagcggccctggg

SEQ ID NO: 454367 - DNA, 394 bp, Homo sapiens
  misc_feature: HEFZJCU01DXL18.47.68.G02.1.454.heavy.3.raw
agctcacgtacacgaccggtgctcgatttagtcgatagtgaagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctagcgcacttctttgacttctgggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 454368 - DNA, 391 bp, Homo sapiens
  misc_feature: HEFZJCU01COFSV.40.66.F11.1.454.heavy.3.raw
tctagcgactcacgaccggtgctcgatttagtcacgcgagaagggaaaggggctggagtgggttggccgtgttaagaccaaacctgagggtggggcaatagactacgctgcacccgtgacaggcagattcgccatctcaagagatgattcagcaggcacggtgtatctggaaatgaacagcctgaaagccgaggacacagccgtgtattattgtaccgcagggctcggctactccgatactgactattggggccagggaaccctggtcaccgtctcctcagcctccaccaagggcccatcggtcttccccctggcgccctgctccaggagcacctccgagagcacagccggccctgggctgcctggtcaaggactacttccagtcgctaga

SEQ ID NO: 454369 - DNA, 519 bp, Homo sapiens; identical to SEQ ID NO: 444867
  misc_feature: HEFZJCU01A2RV2.9.34.D01.1.454.heavy.3.raw

SEQ ID NO: 454370 - DNA, 498 bp, Homo sapiens
  misc_feature: HEFZJCU01B4KI1.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacgtggcaactcctatgcttttgatatctggggccaagggc

SEQ ID NO: 454371 - DNA, 511 bp, Homo sapiens
  misc_feature: HEFZJCU01BR0I7.40.35.D02.1.454.heavy.3.raw
tctagcgactcacgaccggtgctcgatttagcacacgatagttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggaatctgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctc

SEQ ID NO: 454372 - DNA, 513 bp, Homo sapiens
  misc_feature: HEFZJCU01AY8RA.48.34.D01.1.454.heavy.3.raw
agtatacatacacgaccggtgctcgatttagatcgtctgtgttgggtttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctggctgcctggtcaaggacta

SEQ ID NO: 454373 - DNA, 461 bp, Homo sapiens
  misc_feature: HEFZJCU01EQV2S.4.82.H05.1.454.heavy.3.raw
agcactgtagcacgaccggtgctcgatttagtcgagctctctcgcggggagagcatcacccagcaaccacatctgtcctctagagaatcccctgagagctccgttcctcaccatggactggacctggaggatcctcttcttggtggcagcagccacaggagcccactcccaggtgcagctgatgcagtctggggctgaggtgaagaagcctggggcctcagtgatggtctcctgcaaggcttctggattcaccttcaccggctactatttgcactgggtgcgacaggcccctggacaagggcttgagtggatgggatggatcaaccctaatagtggtgccacacactatgcacagacttttctgggcagggtcaccatgaccagggacacgtccatcagcacagcctacatggagctgagcaggctgagatctgacgacacggccgtgtattactgtgtgt

SEQ ID NO: 454374 - DNA, 506 bp, Homo sapiens; identical to SEQ ID NO: 444696
  misc_feature: HEFZJCU01CY0X4.16.34.D01.1.454.heavy.3.raw

SEQ ID NO: 454375 - DNA, 431 bp, Homo sapiens
  misc_feature: HEFZJCU01AF60V.48.73.G07.1.454.heavy.3.raw
agtatacatacacgaccggtgctcgatttagctctacgctcagggcacgaccggtgctcgatttagacgtctcatcagggaaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctgggggcacagcggccctgggctgcctggtcaaggactacttcctatgtatact

SEQ ID NO: 454376 - DNA, 523 bp, Homo sapiens
  misc_feature: HEFZJCU01ERHKQ.52.58.F03.1.454.heavy.3.raw
cgcagtacgacacgaccggtgctcgatttagtctgatcgagaagggaaaggggagctctgggagacgagcccagcactggaagtcgccggtgtttccattcggtgatcatcactgaacacagaggactcaccatggaatttgggctgacttgggttttcctcgttgctcttttaagaggtgtccagtgtcaggtgcaactggtggagtctgggggaggcgtggtccagcctgggaggtccctgagactctcctgtgtcgcctctggattcaccttcagtatttatggcatttattgggtccgtcaggctccaggcaagggctggaatgggtggcctttatttcatatgatggaaccaataaagcctacactgactccgtgaagggccgattcaccatctcccgagacaattccaagaacacactctatctgcaaatgaacagcctgagacatgaggacacggctgttttactcttgtgcgagaattgccctcgtttacgggggcccttttgacaactggggcc

SEQ ID NO: 454377 - DNA, 519 bp, Homo sapiens
  misc_feature: HEFZJCU01DJV6I.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttcccctggccaccctcctccaagagcacctctgggggcacagcggccctgggctgcctggtcaaggactacttcctagagacacg

SEQ ID NO: 454378 - DNA, 392 bp, Homo sapiens
  misc_feature: HEFZJCU01A8PJC.49.46.E02.1.454.heavy.3.raw
agtcgagagacacgaccggtgctcgatttagactcatctacagggaaggggcttgagtggattgggagtatatattttactgggacgtcctactacaacccgtccctcaagagtcgagtcaccatatcagaagacacatccaagaaccaattctccttgaagctgacctctgtgaccgccgcggacacgaccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 454379 - DNA, 523 bp, Homo sapiens
  misc_feature: HEFZJCU01BBYUQ.40.33.C11.1.454.heavy.3.raw
tctagcgactcacgaccggtgctcgatttagagtgagctcgttgggtttgggggagccccagccctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagcctggggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatctccagagacaacgccaagaacacagtgtctctgcaaatggacagtctgagagccgaggacacgggtgtctattattgtacaaaagtggggactaatgaatatggtgtggacgtctggggccaagggaccacggtcgtcg

SEQ ID NO: 454380 - DNA, 505 bp, Homo sapiens; identical to SEQ ID NO: 453549
  misc_feature: HEFZJCU01A2OGJ.12.33.C11.1.454.heavy.3.raw

SEQ ID NO: 454381 - DNA, 504 bp, Homo sapiens
  misc_feature: HEFZJCU01D7NG1.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaaggcccatcggtcttcccctggcgccctgctccaggagcacctctgggggcac

SEQ ID NO: 454382 - DNA, 409 bp, Homo sapiens; identical to SEQ ID NO: 448342
  misc_feature: HEFZJCU01ANDIP.3.41.D08.1.454.heavy.3.raw

SEQ ID NO: 454383 - DNA, 496 bp, Homo sapiens; identical to SEQ ID NO: 444697
  misc_feature: HEFZJCU01BMHN4.16.37.D04.1.454.heavy.3.raw

SEQ ID NO: 454384 - DNA, 510 bp, Homo sapiens
  misc_feature: HEFZJCU01DLP9E.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgcctgctccaggagcacctccgagagcacagtggccctggg

SEQ ID NO: 454385 - DNA, 499 bp, Homo sapiens
  misc_feature: HEFZJCU01DZ99A.11.16.B05.1.454.heavy.3.raw
cgagagataccacgaccggtgctcgatttagagctcacgtattgagctctgggagaagagccccagccccagaattccgaggagtttccattcggtgatcagcactgaacacagaggactcaccatggagtttgggctgagctgggttttccttgttgctattatagaaggtgtccagtgtcaggtgcaactggtggaatctgggggaggcttggtcaagcctggggagtccctgagactctcctgtgcagcctctggattctccttcagtgactcctttatgagttggatccgccaggctccagggcaggggctggaatggatttcatacattggtgaaagtggcagtcccatataccacgcagactctgtgaagggccggttcaccatctccagggacaactccaaaaactcactatatctggaaatgactagcctgagactcgaggacacggccgttattactgtgcgacgcccgccgatagcagcatcatctacg

SEQ ID NO: 454386 - DNA, 519 bp, Homo sapiens
  misc_feature: HEFZJCU01CGGF7.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacaacaatgtatttggaaatgaacagcctaagtcctgaggacacgggtgtatactactgtacgaaggaggggggaaccagcgggagttccaagtactaccg

SEQ ID NO: 454387 - DNA, 510 bp, Homo sapiens; identical to SEQ ID NO: 453756
  misc_feature: HEFZJCU01AQ8J9.47.55.E11.1.454.heavy.3.raw

SEQ ID NO: 454388 - DNA, 523 bp, Homo sapiens
  misc_feature: HEFZJCU01CDZYI.12.86.H09.1.454.heavy.3.raw
  modified_base (380)..(380): a, c, t, g, unknown or other
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttcngtgcgagtcttgatagtagtggttatcctgaatactggggccagggaaccctggtgaccgtctcctcagcctccaccaagggcccatcggtcttcccctggcgcctgctccaggagcacctccgagagcacagcggccctggg

SEQ ID NO: 454389 - DNA, 329 bp, Homo sapiens
  misc_feature: HEFZJCU01E174C.40.20.B09.1.454.heavy.3.raw
tctagcgactcacgaccggtgctcgatttagtgtagtgtgaagggccgattcaccatctccagagacaacgccgggaactccctgtatctgcaaatgaagagcctgcgagccgaggacacgggtgttttattattgtactaaaggacaagagggacttttgggagtactactacggtatggacgtctggggccaagggaccgccgtcaccgtctcctcagcttccaccaagggcccatcggtcttccccctggcgccctgctccaggagcacctctgggggcacagcggccctgggctgcctggtcaaggactacttccagtcgctaga

SEQ ID NO: 454390 - DNA, 530 bp, Homo sapiens
  misc_feature: HEFZJCU01COMKV.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacggggcgtttattactgtgcgagagggacggactacggtgactactgggggttcgaccccgtggggccaggggaaccctggtcaccgtctcctcagccctccaccg

SEQ ID NO: 454391 - DNA, 527 bp, Homo sapiens; identical to SEQ ID NO: 452005
  misc_feature: HEFZJCU01BS0L8.18.33.C11.1.454.heavy.3.raw

SEQ ID NO: 454392 - DNA, 437 bp, Homo sapiens; identical to SEQ ID NO: 444603
  misc_feature: HEFZJCU01BX4XY.3.21.B10.1.454.heavy.3.raw

SEQ ID NO: 454393 - DNA, 375 bp, Homo sapiens
  misc_feature: HEFZJCU01CVY1K.13.42.D09.1.454.heavy.3.raw
tcacgtactacacgaccggtgctcgatttagacacatacgcagggaaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttggggccggggaaccctggtcaccgtcaactcagcctccaccaagggcccatcggtcttccccctggcgccctgctccaggagcacctccgagagcacagcggccctgggctgcctggtcaaggactacttcctagtacgtga

SEQ ID NO: 454394 - DNA, 503 bp, Homo sapiens
  misc_feature: HEFZJCU01CKA2B.48.59.F04.1.454.heavy.3.raw
  modified_base (474)..(474): a, c, t, g, unknown or other
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgccttgatntgtgggccaagggacaagtggtcaccgtt

SEQ ID NO: 454395 - DNA, 403 bp, Homo sapiens; identical to SEQ ID NO: 445029
  misc_feature: HEFZJCU01BC1WD.10.77.G11.1.454.heavy.3.raw

SEQ ID NO: 454396 - DNA, 518 bp, Homo sapiens; identical to SEQ ID NO: 444718
  misc_feature: HEFZJCU01B62AW.9.34.D01.1.454.heavy.3.raw

SEQ ID NO: 454397 - DNA, 484 bp, Homo sapiens
  misc_feature: HEFZJCU01CTQEM.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacaggacacggctatttattattgtgtgagagtaaaggataatgggggctcaaaccaaatttttcactactggggccagggatccctggtcgccgtcggctcagcctccaccaagggcccatcggtcttccccctggcgccctgctccaggagcacctccgacgagcacagcggccctggggctgcctggtcaaggactacttctaccgtgagct

SEQ ID NO: 454398 - DNA, 511 bp, Homo sapiens
  misc_feature: HEFZJCU01DNXLT.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaaggcc

SEQ ID NO: 454399 - DNA, 502 bp, Homo sapiens; identical to SEQ ID NO: 445737
  misc_feature: HEFZJCU01EC6EF.49.80.H03.1.454.heavy.3.raw

SEQ ID NO: 454400 - DNA, 521 bp, Homo sapiens; identical to SEQ ID NO: 447111
  misc_feature: HEFZJCU01BC456.16.86.H09.1.454.heavy.3.raw

SEQ ID NO: 454401 - DNA, 516 bp, Homo sapiens; identical to SEQ ID NO: 453875
  misc_feature: HEFZJCU01B8I8S.17.33.C11.1.454.heavy.3.raw

SEQ ID NO: 454402 - DNA, 483 bp, Homo sapiens; identical to SEQ ID NO: 444639
  misc_feature: HEFZJCU01DM4LJ.11.23.C01.1.454.heavy.3.raw

SEQ ID NO: 454403 - DNA, 532 bp, Homo sapiens; identical to SEQ ID NO: 452968
  misc_feature: HEFZJCU01BUQLL.12.12.B01.1.454.heavy.3.raw

SEQ ID NO: 454404 - DNA, 493 bp, Homo sapiens
  misc_feature: HEFZJCU01EE0JY.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaagggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagatttaggggaatgaccacgtc

SEQ ID NO: 454405 - DNA, 507 bp, Homo sapiens
  misc_feature: HEFZJCU01EJHW5.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttcgtggggccagggg

SEQ ID NO: 454406 - DNA, 507 bp, Homo sapiens
  misc_feature: HEFZJCU01D2BO0.22.11.A11.1.454.heavy.3.raw
acatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaattccaagccgcgggggtcacccaaattgactactc

SEQ ID NO: 454407 - DNA, 500 bp, Homo sapiens; identical to SEQ ID NO: 446033
  misc_feature: HEFZJCU01C3189.11.27.C05.1.454.heavy.3.raw

SEQ ID NO: 454408 - DNA, 499 bp, Homo sapiens
  misc_feature: HEFZJCU01B97M5.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggc

SEQ ID NO: 454409 - DNA, 519 bp, Homo sapiens; identical to SEQ ID NO: 446228
  misc_feature: HEFZJCU01DSF2A.9.43.D10.1.454.heavy.3.raw

SEQ ID NO: 454410 - DNA, 378 bp, Homo sapiens; identical to SEQ ID NO: 444463
  misc_feature: HEFZJCU01C7XUK.47.77.G11.1.454.heavy.3.raw

SEQ ID NO: 454411 - DNA, 518 bp, Homo sapiens; identical to SEQ ID NO: 449255
  misc_feature: HEFZJCU01AT205.3.17.B06.1.454.heavy.3.raw

SEQ ID NO: 454412 - DNA, 395 bp, Homo sapiens; identical to SEQ ID NO: 444517
  misc_feature: HEFZJCU01CIC0T.16.68.G02.1.454.heavy.3.raw

SEQ ID NO: 454413 - DNA, 536 bp, Homo sapiens
  misc_feature: HEFZJCU01CRANA.40.27.C05.1.454.heavy.3.raw
tctagcgactcacgaccggtgctcgatttagacgcgatcgaagggttggggggaagaggaagactgacggtcctgtcccagttgcagttgcaggagtcgggcccaggactggtgaagacttcggagaccctgtccctcacgtgcactgtctctggtggctccatccgcaatcgtcgattctattggggctgggtccgccggcccccagggaaggggctggagtggattgcgagcatatattatgatgagagcgccctctacaacccccccctctacaacccctccctcaagagtcgggtcaccatatctatagacacgtccaacagtcaattctccctggacttgacctctgtgaccgccgcagacacggctgtatattcctgtgcgacccacggaggggatggccccaaatctgcctactttgaccactggggccagggaaccttggtcaccgtctcctcagcctccaccaagggcccatcggtcttcccctggccgccctgctccaggagcacctccgagagcacagcggccct

SEQ ID NO: 454414 - DNA, 500 bp, Homo sapiens
  misc_feature: HEFZJCU01CEJU4.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccagatccggtgagcctacggcagcggcctttgacttc

SEQ ID NO: 454415 - DNA, 396 bp, Homo sapiens; identical to SEQ ID NO: 444568
  misc_feature: HEFZJCU01EQRZ5.47.46.E02.1.454.heavy.3.raw

SEQ ID NO: 454416 - DNA, 519 bp, Homo sapiens; identical to SEQ ID NO: 445330
  misc_feature: HEFZJCU01A02R9.7.78.H01.1.454.heavy.3.raw

SEQ ID NO: 454417 - DNA, 403 bp, Homo sapiens; identical to SEQ ID NO: 444540
  misc_feature: HEFZJCU01DGD3Z.16.72.G06.1.454.heavy.3.raw

SEQ ID NO: 454418 - DNA, 490 bp, Homo sapiens
  misc_feature: HEFZJCU01CH0KT.19.59.F04.1.454.heavy.3.raw
tactctcgtgcacgaccggtgctcgatttagtacacacacttagggattggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggagggtccctgagactctcctgtgcagcctctggattcaccttcagtagttatgaaatgaattgggtccgccaggctccagggaaggggctggagtgggtttcatacattagtagtagtggtagtagcatatactacgcagactctgtgaagggccgattcaccatctccagagacagcgccaagactcactgtatctgcaaatgaacagcctgagagccgaggacacggcagtttatactgtgcgagagagtggct

SEQ ID NO: 454419 - DNA, 506 bp, Homo sapiens; identical to SEQ ID NO: 446520
  misc_feature: HEFZJCU01C0LDK.10.38.D05.1.454.heavy.3.raw

SEQ ID NO: 454420 - DNA, 373 bp, Homo sapiens
  misc_feature: HEFZJCU01EAW55.3.42.D09.1.454.heavy.3.raw
agacgcactccacgaccggtgctcgatttagacacatacgcaggggaaaggggctggagtggattgggagtttctattatggtgggggaacctactacaacccgtccctcaagagtcgagtcaccatatccttagacacgtccaagaaccaattctccctgaaactgaactctatgaccgccgcagacacggctgtttattattgtacgggccgtgtaacgttggactactggggccagggaaccgtggtcaccgtctcctcagcctccaccaagggcccatcggtcttccccctggcaccctcctccaagagcacctctgggggcacagcggccctgggctgcctggtcaaggactacttccgagtgcgtct

SEQ ID NO: 454421 - DNA, 462 bp, Homo sapiens
  misc_feature: HEFZJCU01A5DGQ.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaattggggccagggaaccctggtctccgtctcgtcagcctccaccaagggcccatcggtctcccctggcgccctgctccaggagcacctccgagagcacagcggccctgggctgcctggtcaaggactacttcccacgagagta

SEQ ID NO: 454422 - DNA, 471 bp, Homo sapiens
  misc_feature: HEFZJCU01DO18Q.22.56.F01.1.454.heavy.3.raw
acatacgcgtcacgaccggtgctcgatttagcagacgtctgtcggggttctcattcaccactgcttcagtgggtgtgggctggatccgtcagcccccaggaaaggccctggagtggcttgcactcctttatggggatggcggtgaacactacagtccatctctgaagaccagactcaccatcgcccgggacacctccaagaaccaagtggtccttacactgaccagcatggaccctgtggacacaacaacatatttctgtgcacagagccgccagttagactgggggcctgtcgtggtggttggtgccgcaatgatgcatttcatatttggggccaagggacagtggtcaccgtctcggcagcctccaccaagggcccatcggtcttccccctggcgccctgctccaggagcacctccgagagcacagcggccctgggctgcctggtcaaggactacttccacgcgtatgt

SEQ ID NO: 454423 - DNA, 539 bp, Homo sapiens
  misc_feature: HEFZJCU01BIQ8Y.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatgggtttggggggagtttggggttttttttttacgttacgttacgggtagt

SEQ ID NO: 454424 - DNA, 490 bp, Homo sapiens; identical to SEQ ID NO: 445788
  misc_feature: HEFZJCU01DUHP7.11.26.C04.1.454.heavy.3.raw

SEQ ID NO: 454425 - DNA, 552 bp, Homo sapiens
  misc_feature: HEFZJCU01BO7XX.18.14.B03.1.454.heavy.3.raw
tacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtggattacatttgggggagttatcgcgaaacgggggggtactactacgctatggacgtctggggccaagggaccacggtcaccgtctcctcagcctccaccaagggcccatcggtcttcccctggcaccctcctccaagagcacctctgggggcacg

SEQ ID NO: 454426 - DNA, 512 bp, Homo sapiens; identical to SEQ ID NO: 449104
  misc_feature: HEFZJCU01BQNQ1.11.13.B02.1.454.heavy.3.raw

SEQ ID NO: 454427 - DNA, 481 bp, Homo sapiens
  misc_feature: HEFZJCU01CREA7.7.10.A10.1.454.heavy.3.raw
cgtgtctctacacgaccggtgctcgatttagcgtcgatctcaggggtccctggagactctcctgtgacgcctctggcttcccctttagtgactactacatgagctggatccgccagggtccagggaagggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcacctcctccaagagcacctctgggggcacagcggccctgggctgcctggtcaaggactacttcctagagacacg

SEQ ID NO: 454428 - DNA, 516 bp, Homo sapiens
  misc_feature: HEFZJCU01D1JNR.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggacaatggtcaccgtctcttcagcctccaccaagggcccatcggtcttcccctggcaccctcctccaacgagcacctctgggggcacagcggcccg

SEQ ID NO: 454429 - DNA, 534 bp, Homo sapiens
  misc_feature: HEFZJCU01EX9LZ.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttccccctggcaccctcctccaagagcacctctgggggcac

SEQ ID NO: 454430 - DNA, 506 bp, Homo sapiens; identical to SEQ ID NO: 444696
  misc_feature: HEFZJCU01EOFMX.16.34.D01.1.454.heavy.3.raw

SEQ ID NO: 454431 - DNA, 518 bp, Homo sapiens
  misc_feature: HEFZJCU01CL086.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaaggacacctccacaaacccaggtggtccttacaatgaccaatatggaccctgtggacacagccacatattactgttcacgctctatggttcggggagttattagtccctactttgactactggggccagggaactctggtcaccgtctccgcagcctccaccaaggcccatcc

SEQ ID NO: 454432 - DNA, 512 bp, Homo sapiens; identical to SEQ ID NO: 451002
  misc_feature: HEFZJCU01E0RB5.13.36.D03.1.454.heavy.3.raw

SEQ ID NO: 454433 - DNA, 495 bp, Homo sapiens
  misc_feature: HEFZJCU01D6CJT.52.85.H08.1.454.heavy.3.raw
cgcagtacgacacgaccggtgctcgatttagtatcactcagtcgcggggtatcactcagtcgcggggatactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctgatgcctccatcagtcgtgacgattactactggagctggatccgccagcccccagggaagggcctggaatggattggctacatcttttacagtgagagcacctcctacaacccgtccctcaagagtcgagttaccatatcagctgacaagtccaagaaccacttctccctgaagctgacctctgtgactgccacagacacggccgtctattactgtgccaggagggatcgctagaggtggctccatcgttttagactcc

SEQ ID NO: 454434 - DNA, 393 bp, Homo sapiens; identical to SEQ ID NO: 446764
  misc_feature: HEFZJCU01E2A34.49.42.D09.1.454.heavy.3.raw

SEQ ID NO: 454435 - DNA, 467 bp, Homo sapiens
  misc_feature: HEFZJCU01CN8NO.9.34.D01.1.454.heavy.3.raw
tgatacgtctcacgaccggtgctcgatttagatcgtctgtgttgggtttgggattcacctttgagacctatgccttgacctgggtccgccaggctccaggggagggactggagtgggtcgcaggcatcgctggtggcggtcatgacacattctacgcaaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 454436 - DNA, 529 bp, Homo sapiens
  misc_feature: HEFZJCU01EB57S.48.76.G10.1.454.heavy.3.raw
agtatacatacacgaccggtgctcgatttagtcactcatacaggggctgggagaggagccccagccgtgagattcccaggagttttcacttggtgatcagccctgaaaacagaccaccaaccatggagtttgggcttaactgggttttccttgttgctattttaaaaggtgcccaatgtgaggtgcagctggtggagtctgggggagccttggtacagccaggggggtccctgagactctcctgttcaacttctggattcacctttggtgattatattatgagttgggtccgccaggcgccagggaaggcactggagtgggttgctttcattagtcccaaactttctggtgggacagcatactacgccccgccagaatatgccgcgtctgtgcaaggcagattcaccatgtcaagagatgaatccaaaggtatcgcctatctgcaaatgaacagcctgaaaaccgaggacacagccgtctattactgtactagagcctattttgtacatctggtgtattcaccttcccg

SEQ ID NO: 454437 - DNA, 506 bp, Homo sapiens; identical to SEQ ID NO: 444696
  misc_feature: HEFZJCU01CP0U5.16.34.D01.1.454.heavy.3.raw

SEQ ID NO: 454438 - DNA, 529 bp, Homo sapiens
  misc_feature: HEFZJCU01CT1O0.9.30.C08.1.454.heavy.3.raw
tgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatcccgtggtcaccgtctcctcacgtcctcc

SEQ ID NO: 454439 - DNA, 492 bp, Homo sapiens; identical to SEQ ID NO: 445919
  misc_feature: HEFZJCU01CLWFH.14.25.C03.1.454.heavy.3.raw

SEQ ID NO: 454440 - DNA, 496 bp, Homo sapiens
  misc_feature: HEFZJCU01CXKAT.14.55.E11.1.454.heavy.3.raw
cgtctagtaccacgaccggtgctcgatttagcactcgcacgttgggtttgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtgcagttgtgtggtatgacggaagtaatagaagtatgccgacgccgtgaagggccgattcaccatctccagagacaattccaacaacatgttgtatctgcaaatgaatagcctgagagccgaggacacggctgtgtattactgtgtcagagatggagggggtggtg

SEQ ID NO: 454441 - DNA, 401 bp, Homo sapiens; identical to SEQ ID NO: 448437
  misc_feature: HEFZJCU01DUCQF.11.70.G04.1.454.heavy.3.raw

SEQ ID NO: 454442 - DNA, 376 bp, Homo sapiens; identical to SEQ ID NO: 449134
  misc_feature: HEFZJCU01B5C6B.10.38.D05.1.454.heavy.3.raw

SEQ ID NO: 454443 - DNA, 381 bp, Homo sapiens; identical to SEQ ID NO: 444427
  misc_feature: HEFZJCU01DXNO0.9.53.E09.1.454.heavy.3.raw

SEQ ID NO: 454444 - DNA, 501 bp, Homo sapiens
  misc_feature: HEFZJCU01CIWM6.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggggtgggtggcagtcatatcaattgatggagccataaaattttatgcggactccgtgaacggtcgattcaccatctccagagacaattccaggaacacactgtttctgcaatgaacagcctgagaattgaggactcgggtatatactactgtgcccgtgacccctgactgataaaccggactggttcgacccctgggccagggaaccctggtcaccgtctcctcacg

SEQ ID NO: 454445 - DNA, 495 bp, Homo sapiens; identical to SEQ ID NO: 446614
  misc_feature: HEFZJCU01CNHNZ.13.85.H08.1.454.heavy.3.raw

SEQ ID NO: 454446 - DNA, 462 bp, Homo sapiens
  misc_feature: HEFZJCU01AKCAP.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaattggggccagggaaccctggtctccgtctcgtcagcctccaccaagggcccatcggtcttcccctggcgccctgctccaggagcacctccgagagcacagcggccctgggctgcctggtcaaggactacttcccacgagagta

SEQ ID NO: 454447 - DNA, 384 bp, Homo sapiens; identical to SEQ ID NO: 444454
  misc_feature: HEFZJCU01EXXLX.11.61.F06.1.454.heavy.3.raw

SEQ ID NO: 454448 - DNA, 530 bp, Homo sapiens
  misc_feature: HEFZJCU01EH2VX.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctcgtcaccgtctcctcagcctccaccaagg

SEQ ID NO: 454449 - DNA, 499 bp, Homo sapiens
  misc_feature: HEFZJCU01ESC11.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggccctggacaagggcttgagtggatgggaggagtcatccctctctttcgttcagcagactacgcacagaaattccaggacagagtcacgattaccgcggacgaattccacgaccacagcctacatagagctgcgcagcctgagatctgaagacacggccatttattactgtgcgagagatgcagggccctcccacatcggttattttctttgaccttccgtcggggccgagggaaccctggtccaccgtctcctcg

SEQ ID NO: 454450 - DNA, 395 bp, Homo sapiens; identical to SEQ ID NO: 444517
  misc_feature: HEFZJCU01BHLRJ.16.68.G02.1.454.heavy.3.raw

SEQ ID NO: 454451 - DNA, 518 bp, Homo sapiens; identical to SEQ ID NO: 447436
  misc_feature: HEFZJCU01CQ8CG.13.76.G10.1.454.heavy.3.raw

SEQ ID NO: 454452 - DNA, 532 bp, Homo sapiens; identical to SEQ ID NO: 445228
  misc_feature: HEFZJCU01CGZNM.7.78.H01.1.454.heavy.3.raw

SEQ ID NO: 454453 - DNA, 527 bp, Homo sapiens
  misc_feature: HEFZJCU01BEHWW.51.34.D01.1.454.heavy.3.raw
cgatcgtatacacgaccggtgctcgatttagatcgtctgtgttgggtttggggagctctgagagaggagcccagccctgggattttcaggtgttttcatttggtgatcaggactgaacagagagaactcaccatggagtttgggctgagctggcttttcttgtggctattttaaaaggtggccagtgtgaggtgcagctgttagagtctgggggaggcttggtccagcctggggggtccctcagactctcctgtgcagcctcgggaattatatttaagaactttgccatgagttgggtccgccaggctccagggaaggggctggaatgggtctccactattagtggcagcggtgatgacacattctacacagactccgtgaggggccgtttcaccatctcccagagacaatgccaaagacacgctctatctggaagtgaagagcctgagagtcgaggacacggccgtcttttattgtgtgaagggggcgtggggactttatctttcagggaccatattacttttgta

SEQ ID NO: 454454 - DNA, 532 bp, Homo sapiens
  misc_feature: HEFZJCU01CS4WX.49.59.F04.1.454.heavy.3.raw
agtcgagagacacgaccggtgctcgatttagtacacacacttagggattggggcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactggggccagggaaccctggtcaccgtctcctcagcctccaccaagggcccatcggtcttcccctggcaccctcctccaagagcaccgtcttcggggggcaccagccggccctggggctggccctggtcaaac

SEQ ID NO: 454455 - DNA, 416 bp, Homo sapiens
  misc_feature: HEFZJCU01CJSZI.40.81.H04.1.454.heavy.3.raw
tctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggat

SEQ ID NO: 454456 - DNA, 505 bp, Homo sapiens
  misc_feature: HEFZJCU01C5VYX.2.49.E05.1.454.heavy.3.raw
acgctcgacacacgaccggtgctcgatttagagcgactagcaacacacaaagggggccccagccctgggattcccagctgtttctgcttgctgatcaggactgcacacagagaactcaccatggagtttgggctgagctgggttttccttgttgctattttaaaaggtgtccagtgcgaggtgctgctggtggagtccgggggaggcttagttcagcctggggggtccctgagactctcctgtgcagcctctggattcaccttcagtcgctactggatgcactggttccgccaagttccagggaaggggctggagtgggtctcacgcattgatccatctgggaataggattaactacgcggcctccgtgaggggccgattcaccatctccagagacaacgccaggaacactctgtatctggaaatgagcagtctcagagcgaggacacggctgtttattactgcacaagtgacgcgttcggggagactgactactggggccaggg

SEQ ID NO: 454457 - DNA, 497 bp, Homo sapiens
  misc_feature: HEFZJCU01BC676.51.35.D02.1.454.heavy.3.raw
cgatcgtatacacgaccggtgctcgatttagcacacgatagttgggtttgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 454458 - DNA, 492 bp, Homo sapiens; identical to SEQ ID NO: 445919
  misc_feature: HEFZJCU01EN9EW.14.25.C03.1.454.heavy.3.raw

SEQ ID NO: 454459 - DNA, 492 bp, Homo sapiens
  misc_feature: HEFZJCU01EU7BI.52.55.E11.1.454.heavy.3.raw
cgcagtacgacacgaccggtgctcgatttagcactcgcacgttgggtttgggggaggcttggtccagcctggtggttccctgagactctcctgtgcagcctctggatttccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccggtcaccgtctcctcagcctccaccaagggcccatcggtcttcccctggcaccctcctccaagagcacctctgggggcacagcggccctgggctgcctggtcaaggactacttcctatacgatcg

SEQ ID NO: 454460 - DNA, 500 bp, Homo sapiens
  misc_feature: HEFZJCU01BV9D9.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccaagggacaagtggtcaccgtctc

SEQ ID NO: 454461 - DNA, 386 bp, Homo sapiens; identical to SEQ ID NO: 446054
  misc_feature: HEFZJCU01AO6TI.18.60.F05.1.454.heavy.3.raw

SEQ ID NO: 454462 - DNA, 505 bp, Homo sapiens
  misc_feature: HEFZJCU01BTVBV.51.59.F04.1.454.heavy.3.raw
cgatcgtatacacgaccggtgctcgatttagtacacacacttagggattggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaatgaacagcctgagagctgaggacacggctatgttttactgtgcgagagggaactcgattacagcagccctacg

SEQ ID NO: 454463 - DNA, 514 bp, Homo sapiens
  misc_feature: HEFZJCU01B4VI1.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattgggagcgactggttcgacccctggggccagggaaccctggtcaccgtctcctcagcctccaccaacgggcccatcggtccttccccctggccaccctcctccaagagcacctcgtgggggcacagccggccctgggctgcctggtcaaggactacttcctacgtcgtat

SEQ ID NO: 454464 - DNA, 520 bp, Homo sapiens
  misc_feature: HEFZJCU01BEIAV.53.10.A10.1.454.heavy.3.raw
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccagggggacctttgggggtttcgacccctggggccagggaaccctggtcaccgtctcctcagcctccaccagggcccatcggtcttcccctggcaccctcctccaagagca

SEQ ID NO: 454465 - DNA, 521 bp, Homo sapiens; identical to SEQ ID NO: 446749
  misc_feature: HEFZJCU01EXBIP.9.63.F08.1.454.heavy.3.raw

SEQ ID NO: 454466 - DNA, 531 bp, Homo sapiens; identical to SEQ ID NO: 446857
  misc_feature: HEFZJCU01D8LI6.7.78.H01.1.454.heavy.3.raw

SEQ ID NO: 454467 - DNA, 514 bp, Homo sapiens
  misc_feature: HEFZJCU01EAH1B.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggcccgattcaccatctccagagacaattccaagaacacgctgttcttcaaatgaacagcctgagagccgatgacacggccgtgtattactgtgcgagagatggggcccacgaacgttactacgctatggacgtctggggaccg

SEQ ID NO: 454468 - DNA, 513 bp, Homo sapiens
  misc_feature: HEFZJCU01DEXWH.48.24.C02.1.454.heavy.3.raw
  modified_base (503)..(503): a, c, t, g, unknown or other
agtatacatacacgaccggtgctcgatttagtacagatcgttagggaaaggggtctgagagaggagcccagccctgggattctcaggtgttttcatttggtgatcaggactgaacagagagaactcaccatggagtttgggctgagcgtggcttttcttaggtggctattttaaaaggtgtccagtgtgaggtgcacctgttggagtctgggggaggcttggtacagcctggggggtccctgagactctcctgtgcagcctctggattcacctttagcagctatgccatgagctgggtccgccaggctccagggacggggctggagtgggtctcagctattagtggtagtggtggtggcacatactacgcagactccgtgaagggccggttcaccatctccagagacaattccaagaacacactttatctgcgaatgaacagcctgagagccgaggacacggccgtatattactgtgcgaaagagtcagggttactatgatancgggagattt

SEQ ID NO: 454469 - DNA, 400 bp, Homo sapiens; identical to SEQ ID NO: 444452
  misc_feature: HEFZJCU01EEU6R.47.24.C02.1.454.heavy.3.raw

SEQ ID NO: 454470 - DNA, 399 bp, Homo sapiens; identical to SEQ ID NO: 444537
  misc_feature: HEFZJCU01CJ1I3.16.29.C07.1.454.heavy.3.raw

SEQ ID NO: 454471 - DNA, 504 bp, Homo sapiens
  misc_feature: HEFZJCU01EJ3K4.48.59.F04.1.454.heavy.3.raw
agtatacatacacgaccggtgctcgatttagtacacacacttagggattggggatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctgggctggatccgccagcccccagggaaggggctggagtggattgggagtatttaccacagtgggagcacctactacaacccgtccctcaaaagtcgaggcaccatatccgtagacacgtccaagaccaattctccctgaagctgagctctgtgaccgccgcagacacggctgtctattactgtgcgaggccccgagcgcagtggcttttgatgcctttgatatgtggggccaagggacaatggtcaccgtctcttcagcctccaccg

SEQ ID NO: 454472 - DNA, 529 bp, Homo sapiens
  misc_feature: HEFZJCU01B8K03.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactgggccagggaaccctggtcaccgtctcctcagcctccaccaggg

SEQ ID NO: 454473 - DNA, 534 bp, Homo sapiens; identical to SEQ ID NO: 446321
  misc_feature: HEFZJCU01DDVNB.22.38.D05.1.454.heavy.3.raw

SEQ ID NO: 454474 - DNA, 505 bp, Homo sapiens; identical to SEQ ID NO: 445664
  misc_feature: HEFZJCU01DZT4B.12.33.C11.1.454.heavy.3.raw

SEQ ID NO: 454475 - DNA, 498 bp, Homo sapiens
  misc_feature: HEFZJCU01C5PE3.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcgtggttttccgtcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaagatttctatagaggtgactac

SEQ ID NO: 454476 - DNA, 502 bp, Homo sapiens
  misc_feature: HEFZJCU01EICQD.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgcaagaactcactgtatctgcaaatgaacagcctgagagcgaggacacggctgtgtattactgtgcgagaggagctattatcgtacggaaccccgagt

SEQ ID NO: 454477 - DNA, 498 bp, Homo sapiens; identical to SEQ ID NO: 445952
  misc_feature: HEFZJCU01A7G33.11.71.G05.1.454.heavy.3.raw

SEQ ID NO: 454478 - DNA, 519 bp, Homo sapiens; identical to SEQ ID NO: 444867
  misc_feature: HEFZJCU01AHU4B.9.34.D01.1.454.heavy.3.raw

SEQ ID NO: 454479 - DNA, 491 bp, Homo sapiens; identical to SEQ ID NO: 447995
  misc_feature: HEFZJCU01A7LAB.14.25.C03.1.454.heavy.3.raw

SEQ ID NO: 454480 - DNA, 477 bp, Homo sapiens; identical to SEQ ID NO: 444659
  misc_feature: HEFZJCU01B8L9Q.16.10.A10.1.454.heavy.3.raw

SEQ ID NO: 454481 - DNA, 500 bp, Homo sapiens
  misc_feature: HEFZJCU01EK9LB.11.73.G07.1.454.heavy.3.raw
cgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttcaaaagtttcgaaatgagctgggtccgccaggctcctgggaaggggccggagtggatttcatacatcagtagtagtggtaacaccttgtactatgcagactctgtgaagggccgattcaccatctccagagacaacgccaagaattcactgtttctgcaaatgaacagcctgagagacgaggatacggactatttactattgtgcgcgatcgacagaaaagcggtggcctagtc

SEQ ID NO: 454482 - DNA, 526 bp, Homo sapiens
  misc_feature: HEFZJCU01AXGVU.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaagggcccatcggtcttccccctggcaccctcctccaagagcacctctgggggcacagcggccctgggctgcctgtcaaggactacttcccatactcgta

SEQ ID NO: 454483 - DNA, 390 bp, Homo sapiens; identical to SEQ ID NO: 447568
  misc_feature: HEFZJCU01BUWMF.12.24.C02.1.454.heavy.3.raw

SEQ ID NO: 454484 - DNA, 435 bp, Homo sapiens; identical to SEQ ID NO: 447770
  misc_feature: HEFZJCU01EU0L8.40.27.C05.1.454.heavy.3.raw

SEQ ID NO: 454485 - DNA, 523 bp, Homo sapiens
  misc_feature: HEFZJCU01EHDPM.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggtcgtcgtgggggcctaggggactacggtcaccgtctcctcagcctccaccaacgggcccatcggtcctttcccccgtggccta

SEQ ID NO: 454486 - DNA, 521 bp, Homo sapiens; identical to SEQ ID NO: 445317
  misc_feature: HEFZJCU01B5XI4.12.40.D07.1.454.heavy.3.raw

SEQ ID NO: 454487 - DNA, 488 bp, Homo sapiens; identical to SEQ ID NO: 444651
  misc_feature: HEFZJCU01C5AYW.16.67.G01.1.454.heavy.3.raw

SEQ ID NO: 454488 - DNA, 518 bp, Homo sapiens; identical to SEQ ID NO: 444718
  misc_feature: HEFZJCU01D3YKQ.9.34.D01.1.454.heavy.3.raw

SEQ ID NO: 454489 - DNA, 523 bp, Homo sapiens
  misc_feature: HEFZJCU01BCIQL.53.76.G10.1.454.heavy.3.raw
cgcgtatacacacgaccggtgctcgatttagtcactcatacaggggttgggggcaacttataaacccaaaaggaatggccatgcagcgggtagggacaatacagacagatctcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcaggcctggacatcccgggtttccccaggcctggcggtaggtttggggtgaggtctgtgtcactgtggtatgacgatttttggcgtggtttttccttcactattactcccactactacggtttggacgtctggggccaagggaccacggtcaccgtctcctcagcctccaccaagggcccatcggtcttcccctggcaccctcctccaagagcacctctgggggcacagcggccctgggctgcctggtcaaggactacttcctcgtctgcg

SEQ ID NO: 454490 - DNA, 487 bp, Homo sapiens
  misc_feature: HEFZJCU01AZIBE.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctggctgcctggtcaggactacttcccatactcgta

SEQ ID NO: 454491 - DNA, 524 bp, Homo sapiens; identical to SEQ ID NO: 445902
  misc_feature: HEFZJCU01EXHIE.9.78.H01.1.454.heavy.3.raw

SEQ ID NO: 454492 - DNA, 483 bp, Homo sapiens
  misc_feature: HEFZJCU01DVJJK.19.71.G05.1.454.heavy.3.raw
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtcccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggccccatagacatgccacctcgtctctggtgct

SEQ ID NO: 454493 - DNA, 497 bp, Homo sapiens; identical to SEQ ID NO: 445400
  misc_feature: HEFZJCU01ECO1C.40.37.D04.1.454.heavy.3.raw

SEQ ID NO: 454494 - DNA, 505 bp, Homo sapiens; identical to SEQ ID NO: 445664
  misc_feature: HEFZJCU01B7NV4.12.33.C11.1.454.heavy.3.raw

SEQ ID NO: 454495 - DNA, 524 bp, Homo sapiens; identical to SEQ ID NO: 446401
  misc_feature: HEFZJCU01AXD1E.3.82.H05.1.454.heavy.3.raw

SEQ ID NO: 454496 - DNA, 509 bp, Homo sapiens; identical to SEQ ID NO: 444586
  misc_feature: HEFZJCU01CG7Q3.12.78.H01.1.454.heavy.3.raw

SEQ ID NO: 454497 - DNA, 469 bp, Homo sapiens
  misc_feature: HEFZJCU01BQM2R.48.56.F01.1.454.heavy.3.raw
agtatacatacacgaccggtgctcgatttagcagacgtctgaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtggtggcacacgctattcacagaagtttcagggcagggtcaccatgaccagggacacgtccatcagcacagcctacatggaattgagcaggctgacatctgacgacacggccgtgtattattgtgcgagag

SEQ ID NO: 454498 - DNA, 360 bp, Homo sapiens
  misc_feature: HEFZJCU01CQP5I.40.41.D08.1.454.heavy.3.raw
tctagcgactcacgaccggtgctcgatttagtcacgcgagaaagggaaaggggggagcaccaactacaacccctccctcaagagtcgagtcaccatatcagtagacacgtccaagaaccagttctccctgaagctgagctctgtgaccgctgcggacacggccgtgtattactgtgcgagagggctgggattactatggttcggggagttattagtctggggccagggaaccctggtcaccgtctcctcagcttccaccaagggcccatcggtcttccccctggcgccctgctccaggagcacctctgggggcacagcggccctgggctgcctggtcaaggactacttccagtcgctaga

SEQ ID NO: 454499 - DNA, 514 bp, Homo sapiens; identical to SEQ ID NO: 448304
  misc_feature: HEFZJCU01D6YH2.26.12.B01.1.454.heavy.3.raw

SEQ ID NO: 454500 - DNA, 502 bp, Homo sapiens
  misc_feature: HEFZJCU01CT7L2.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgatacggccgtctattactgtgcgagagtcccacgatccggtgagcctacggcagcggcctttgactttc

SEQ ID NO: 454501 - DNA, 513 bp, Homo sapiens
  misc_feature: HEFZJCU01C8R9I.9.34.D01.1.454.heavy.3.raw
  modified_base (456)..(456): a, c, t, g, unknown or other
  modified_base (461)..(461): a, c, t, g, unknown or other
  modified_base (472)..(472): a, c, t, g, unknown or other
  modified_base (482)..(482): a, c, t, g, unknown or other
  modified_base (510)..(510): a, c, t, g, unknown or other
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggggccgggaaccctggtcgccgtctcctcagcctccacaagggcccatcggtcttcccctggcaccctcctccaagngcacnctgggggcacngcgccgtggntgcctggtcaaggactactccagacgtntca

SEQ ID NO: 454502 - DNA, 528 bp, Homo sapiens
  misc_feature: HEFZJCU01CBGAO.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactacgtgggggccggggagcccggtcatcgtctcc

SEQ ID NO: 454503 - DNA, 503 bp, Homo sapiens; identical to SEQ ID NO: 445995
  misc_feature: HEFZJCU01AZBGO.17.25.C03.1.454.heavy.3.raw

SEQ ID NO: 454504 - DNA, 392 bp, Homo sapiens; identical to SEQ ID NO: 444682
  misc_feature: HEFZJCU01D0KEJ.16.70.G04.1.454.heavy.3.raw

SEQ ID NO: 454505 - DNA, 522 bp, Homo sapiens; identical to SEQ ID NO: 446788
  misc_feature: HEFZJCU01CVAQU.12.40.D07.1.454.heavy.3.raw

SEQ ID NO: 454506 - DNA, 518 bp, Homo sapiens; identical to SEQ ID NO: 444718
  misc_feature: HEFZJCU01BF9LB.9.34.D01.1.454.heavy.3.raw

SEQ ID NO: 454507 - DNA, 525 bp, Homo sapiens
  misc_feature: HEFZJCU01DKVCK.22.11.A11.1.454.heavy.3.raw
acatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattcaagccgcgggggtcacccaaattgactactggggccgagggaacccgtggtcaccgtctcctcagcctccaccaagggcccatcggtcttcccctggcgccctgctccac

SEQ ID NO: 454508 - DNA, 496 bp, Homo sapiens
  misc_feature: HEFZJCU01CUT84.40.37.D04.1.454.heavy.3.raw
tctagcgactcacgaccggtgctcgatttagtagcatactgttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccggggaatcctggtcaccatctcctcagcctccaccaagggcccatcggtcttcccctggcgccctgctccaggagcacctccgagagcacagcggccctgggctgcctggtcaaggactacttccagtgctaga

SEQ ID NO: 454509 - DNA, 503 bp, Homo sapiens; identical to SEQ ID NO: 445995
  misc_feature: HEFZJCU01DHFMC.17.25.C03.1.454.heavy.3.raw

SEQ ID NO: 454510 - DNA, 431 bp, Homo sapiens
  misc_feature: HEFZJCU01CNGW2.40.34.D01.1.454.heavy.3.raw
tctagcgactcacgaccggtgctcgatttagatcgtctgtgttgggtttgggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttcagcttccaccaagggcccatcggtcttccccctggcgccctgctccaggagcaccctctgggggcacagcggccctgggctgcctggtcaaggactacttccagtcgctaga

SEQ ID NO: 454511 - DNA, 521 bp, Homo sapiens
  misc_feature: HEFZJCU01DR63M.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaaccctccctcaggagtccagtcgccatatccctggactcgtccaacaaccagatctccctgacgatgacatctgtgaccgctgcggacacagccgtttattactgtgcgcgatcgtgggcgactcagtgactatggtatggacgtcgtgggggccaagggaccacggtcatcgtctcctcagcctccaaccaacgggcccagtccggtccttccccctggccta

SEQ ID NO: 454512 - DNA, 491 bp, Homo sapiens; identical to SEQ ID NO: 445531
  misc_feature: HEFZJCU01BTFM9.11.38.D05.1.454.heavy.3.raw

SEQ ID NO: 454513 - DNA, 491 bp, Homo sapiens
  misc_feature: HEFZJCU01EKRZV.40.22.B11.1.454.heavy.3.raw
tctagcgactcacgaccggtgctcgatttagacgacagctcaggggctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggggggtccctgagactctcctgtgcagcctctggattcaccttcagtagctatagcataaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtatattactgtgcgagagagccaggtggctacaatt

SEQ ID NO: 454514 - DNA, 520 bp, Homo sapiens
  misc_feature: HEFZJCU01DQJOU.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacaatgaccaacgtgaagcctgcggacacggccacatattattgtgcacaccgacgctataccgccagctagggaatcgacaactggttcgaccccgtggggccagggaacccttgtcaccgtctcctcagcctccaccaaggccctacg

SEQ ID NO: 454515 - DNA, 518 bp, Homo sapiens; identical to SEQ ID NO: 444718
  misc_feature: HEFZJCU01AJL2P.9.34.D01.1.454.heavy.3.raw

SEQ ID NO: 454516 - DNA, 528 bp, Homo sapiens
  misc_feature: HEFZJCU01COSEW.12.12.B01.1.454.heavy.3.raw
atacgacgtacacgaccggtgctcgatttagtagtgtagattccgcggggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagccccagggaaggggctggagtggattgggagtatctattttagcgggagcacctaccagaacgcgtcctcaagagtcgaatcaccatgtcggtggacacatcgaagaaccagatctcccttaagttgaggtctgtgaccgccgctgacacggccgtctattactgtgcgagagtccgtgctggaagaactacttttttgactattggggccagggatcctggtcaccgtcgcctcagcctcaccaaggcccatcggtcttccccg

SEQ ID NO: 454517 - DNA, 491 bp, Homo sapiens
  misc_feature: HEFZJCU01CR3QN.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccggggaccctggtcaccgtctcctcggcctccaccaagggcccatcggtcttcccctggcgccctgctccaggagcacctccgagagcacagcggccctgggctgcctggtcaaggactattccctacagtgct

SEQ ID NO: 454518 - DNA, 500 bp, Homo sapiens; identical to SEQ ID NO: 444529
  misc_feature: HEFZJCU01ELH21.12.38.D05.1.454.heavy.3.raw

SEQ ID NO: 454519 - DNA, 387 bp, Homo sapiens
  misc_feature: HEFZJCU01BVTLR.16.77.G11.1.454.heavy.3.raw
tgtactactccacgaccggtgctcgatttagctagtcactcaagggaagggcctggagtggattgcgactatgtaccatagtgggagcacttactacaacccgtccctcaggagtcgagtcaccacatccgtagacacgtccacgaaccagttctccctgaggctgagctctgtgaccgccgcagacacggctgtttattactgtgtgagacattttcgttttgttatgcggggagttgactactggggccagggaacccgagtcaccgtctcctcagcctccaccaagggcccatcggtcttccccctggcaccctcctccaagagcacctctgggggcacagcggccctgggctgcctggtcaaggactacttccgagtagtaca

SEQ ID NO: 454520 - DNA, 437 bp, Homo sapiens; identical to SEQ ID NO: 444603
  misc_feature: HEFZJCU01DGLOB.3.21.B10.1.454.heavy.3.raw

SEQ ID NO: 454521 - DNA, 502 bp, Homo sapiens
  misc_feature: HEFZJCU01B0ZAU.17.10.A10.1.454.heavy.3.raw
cgtagactagcacgaccggtgctcgatttagcgtcgatctcaggggacccaaaaactacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttcgtc

SEQ ID NO: 454522 - DNA, 479 bp, Homo sapiens; identical to SEQ ID NO: 450171
  misc_feature: HEFZJCU01A0APQ.14.70.G04.1.454.heavy.3.raw

SEQ ID NO: 454523 - DNA, 500 bp, Homo sapiens
  misc_feature: HEFZJCU01DNG44.12.38.D05.1.454.heavy.3.raw
atacgacgtacacgaccggtgctcgatttagtatctgatagttgggtcgtgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagagcacagcggccctgggctgcctggtcaaggactacttcctacgtcgta

SEQ ID NO: 454524 - DNA, 510 bp, Homo sapiens
  misc_feature: HEFZJCU01BY4X0.18.78.H01.1.454.heavy.3.raw
tacgagtatgcacgaccggtgctcgatttagtgtgagtagtttgggtttggggctgggagaggagctccagccttgggattcccagctgtctccactcggtgatcggcactgaatacaggagactcaccatggagtttgggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtattttgtgcgagcgaccggggctcctcaatggctttcattactggggccg

SEQ ID NO: 454525 - DNA, 508 bp, Homo sapiens
  misc_feature: HEFZJCU01EF2OM.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggaggggggaaccagcggagtccaagtactcctttg

SEQ ID NO: 454526 - DNA, 509 bp, Homo sapiens
  misc_feature: HEFZJCU01B6UX5.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgatccgggtgacgcctacggcaggcggtcctttgactttcgc

SEQ ID NO: 454527 - DNA, 472 bp, Homo sapiens
  misc_feature: HEFZJCU01D0J9P.48.51.E07.1.454.heavy.3.raw
agtatacatacacgaccggtgctcgatttagcatactctacaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtggtggcacacgctattcacagaagtttcagggcagggtcaccatgaccagggacacgtccatcagcacagcctacatggaattgagcaggctgacatctgacgacacggccgtgcattattgtgcgagagcct

SEQ ID NO: 454528 - DNA, 491 bp, Homo sapiens
  misc_feature: HEFZJCU01D3H84.40.85.H08.1.454.heavy.3.raw
tctagcgactcacgaccggtgctcgatttagtatcactcagtcgcggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccagggaaccctgggtcaccgtctcctcagcctccaccaagggcccatcggtcttcccctggcgccctgctccaggagcacctccgagagcacagcggccctgggctgcctggtcaaggactacttccagtcgctaga

SEQ ID NO: 454529 - DNA, 501 bp, Homo sapiens; identical to SEQ ID NO: 447123
  misc_feature: HEFZJCU01DH3NC.3.20.B09.1.454.heavy.3.raw

SEQ ID NO: 454530 - DNA, 511 bp, Homo sapiens
  misc_feature: HEFZJCU01D8LIE.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttcgtggggccaggggaccg

SEQ ID NO: 454531 - DNA, 497 bp, Homo sapiens
  misc_feature: HEFZJCU01B67XM.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtgctacgagtactggtacttcgatctctgggccgtggcaccctgctgactgtctcctcagcctccaccaagggcccatcggtcttcccctggcgccctgctccaggagcacctccgagacgcacagcggccctgggctgcctggtcaaggactaccg

SEQ ID NO: 454532 - DNA, 505 bp, Homo sapiens
  misc_feature: HEFZJCU01CBQH4.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggcttcagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggccctgggctgcctggtcaaggctacttccgagtagtaca

SEQ ID NO: 454533 - DNA, 498 bp, Homo sapiens
  misc_feature: HEFZJCU01DO988.13.15.B04.1.454.heavy.3.raw
tcacgtactacacgaccggtgctcgatttagacagtatatatccgcgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagagtacacattaaattactatgatagtagtgg

SEQ ID NO: 454534 - DNA, 484 bp, Homo sapiens; identical to SEQ ID NO: 445876
  misc_feature: HEFZJCU01D4BHD.8.39.D06.1.454.heavy.3.raw

SEQ ID NO: 454535 - DNA, 470 bp, Homo sapiens
  misc_feature: HEFZJCU01DRBFB.52.83.H06.1.454.heavy.3.raw
cgcagtacgacacgaccggtgctcgatttagatcacgtgcgtcgcgggcacgaccggtgctcgatttagtgtgagtagtttgggtttgggggaggcttggcacagcctggctggtctccgagactctcctgtgtagggtctggactcaccttggatgcttttggcacgcactgggtctggcaaactccagggaagggcccagagtgggcctcaaatatcacttggaatagtgaaatcatcgcctgtggggtctgtctgtggggccgactcagcatctccagagacaacgccagtaacgtcatccgtctgcaagtgaatcccagactactggggccaggggaggctggtcaccgtctcttgagcctccaccaagggcccatcggtcttccccctggcaccctcctccaagagcacctctggggcacagcggccctgggctgcctggtcaaggactacttcctatacgatcg

SEQ ID NO: 454536 - DNA, 484 bp, Homo sapiens
  misc_feature: HEFZJCU01DQFYA.19.71.G05.1.454.heavy.3.raw
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccccatagacatgccacctcgtctctggtgcta

SEQ ID NO: 454537 - DNA, 506 bp, Homo sapiens; identical to SEQ ID NO: 448313
  misc_feature: HEFZJCU01DR785.52.34.D01.1.454.heavy.3.raw

SEQ ID NO: 454538 - DNA, 500 bp, Homo sapiens; identical to SEQ ID NO: 445811
  misc_feature: HEFZJCU01EW341.48.34.D01.1.454.heavy.3.raw

SEQ ID NO: 454539 - DNA, 477 bp, Homo sapiens; identical to SEQ ID NO: 444659
  misc_feature: HEFZJCU01AEPV0.16.10.A10.1.454.heavy.3.raw

SEQ ID NO: 454540 - DNA, 521 bp, Homo sapiens
  misc_feature: HEFZJCU01CV2F6.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagtaatctgagctgaacagcctgtcatctgaggacacgggcttctacttctgtgcgaggagtaatactatacactgctccttttacacctcctgacttctgggccatggaacccggtccg

SEQ ID NO: 454541 - DNA, 517 bp, Homo sapiens; identical to SEQ ID NO: 445684
  misc_feature: HEFZJCU01BCYPW.9.34.D01.1.454.heavy.3.raw

SEQ ID NO: 454542 - DNA, 506 bp, Homo sapiens
  misc_feature: HEFZJCU01EQR9O.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagtcttttgactactggggccagggaccctggtcatcgtctcctcagcctccaccaaggcccatcggtcttcccctggccaccctcctccaagagcacctctgggggcacagcggccctgggctgcctggtcaaggactacttccgagtagtaca

SEQ ID NO: 454543 - DNA, 506 bp, Homo sapiens
  misc_feature: HEFZJCU01BGSGR.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaaggcccatcggtcttcccctggcgccctgctccaggacg

SEQ ID NO: 454544 - DNA, 483 bp, Homo sapiens; identical to SEQ ID NO: 444532
  misc_feature: HEFZJCU01CSITK.47.59.F04.1.454.heavy.3.raw

SEQ ID NO: 454545 - DNA, 525 bp, Homo sapiens
  misc_feature: HEFZJCU01DP84X.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaagggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatgggttgggggagttgggttttttcgtacgtacgggat

SEQ ID NO: 454546 - DNA, 496 bp, Homo sapiens
  misc_feature: HEFZJCU01BOURX.40.81.H04.1.454.heavy.3.raw
tctagcgactcacgaccggtgctcgatttagtagtgtagattcgcgggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtatttactgttggaagagacgttggtggctaccgcggggctgaccactc

SEQ ID NO: 454547 - DNA, 491 bp, Homo sapiens; identical to SEQ ID NO: 444592
  misc_feature: HEFZJCU01CG9YA.11.26.C04.1.454.heavy.3.raw

SEQ ID NO: 454548 - DNA, 482 bp, Homo sapiens; identical to SEQ ID NO: 444503
  misc_feature: HEFZJCU01CDFU3.7.10.A10.1.454.heavy.3.raw

SEQ ID NO: 454549 - DNA, 525 bp, Homo sapiens; identical to SEQ ID NO: 447753
  misc_feature: HEFZJCU01D7YDN.16.27.C05.1.454.heavy.3.raw

SEQ ID NO: 454550 - DNA, 477 bp, Homo sapiens; identical to SEQ ID NO: 444659
  misc_feature: HEFZJCU01ELF0F.16.10.A10.1.454.heavy.3.raw

SEQ ID NO: 454551 - DNA, 509 bp, Homo sapiens
  misc_feature: HEFZJCU01CN5NK.52.29.C07.1.454.heavy.3.raw
cgcagtacgacacgaccggtgctcgatttagagtgctacgaagggaaaggggcctctactgatgaaaaccagcccagccctgaccctgcagctctgggagacgagcccagcactggaaggcgccggtgtttccattcggtgatcagcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtacaccctctggattcaccttcagcaactatgcaatgcactgggtccgctggctcccggcaagggtctggactgggtggcaggtatatcagatgatgggaccaaaaatactacgcaaactccgtgaagggccgattcaccgtatctagagacagttccgatgacacaatctatctgcaaatgaacagcctgaaagttgacgacacgggttctttttact

SEQ ID NO: 454552 - DNA, 514 bp, Homo sapiens
  misc_feature: HEFZJCU01CZZ7E.51.77.G11.1.454.heavy.3.raw
cgatcgtatacacgaccggtgctcgatttagctagtcactcaagggaaaggggcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatttcatatgatggaagtaaaatattctatgtagactccgtgaagggccgcttcatcatctccagagacaattcccagaacaccctgtttctgcaaatgcacagcctgagacctgaggacacggctgtgtattactgtgcgaacttaatcacggaggacaacggtgacccccgtccgctcggtgcggaggtctgggccaagggaccacggtcatcgtctcctcagcctccaccaagggcccatcggtcttcccctggcaccctcctccaagagcacctctggggcacagcgccctgggctgcctggtcaaggactac

SEQ ID NO: 454553 - DNA, 493 bp, Homo sapiens
  misc_feature: HEFZJCU01EJFRR.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggcgttttcttggtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagatttggggaatgacactc

SEQ ID NO: 454554 - DNA, 488 bp, Homo sapiens; identical to SEQ ID NO: 445460
  misc_feature: HEFZJCU01BJL73.47.85.H08.1.454.heavy.3.raw

SEQ ID NO: 454555 - DNA, 489 bp, Homo sapiens; identical to SEQ ID NO: 444791
  misc_feature: HEFZJCU01ANIVJ.47.85.H08.1.454.heavy.3.raw

SEQ ID NO: 454556 - DNA, 512 bp, Homo sapiens
  misc_feature: HEFZJCU01C7QIL.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccaggccggggggtccctgagactgtcctgtgtagtctctgggttcagcgtcagtcgcgaccatatgagttggttccgccaggctccagggaagggctggagtggctcgcacttatttacagtggcggcactacatactacacagacttcgcgaggggccgattcaccatctccagagacgattccaagaacacgttgtatcgggggttacaaatgaacagcctgacagtcgacgacacggccatgtattttgtgcgagcgacccggggctcctcaatggctttcattacg

SEQ ID NO: 454557 - DNA, 517 bp, Homo sapiens
  misc_feature: HEFZJCU01DUAV5.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggggtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggccaccctcctccaagagcacctctgggggcacagcggcctggctgcctggtcaaggactacttccagacgtatca

SEQ ID NO: 454558 - DNA, 524 bp, Homo sapiens
  misc_feature: HEFZJCU01CM31H.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctgggccggggaaccctggtcaccgtctccccaccctccaccaagggcccatcggtcttccccctggcaccctcctccaagagcacctctgggggcacagcggcctgggctgcctggtcaaggactacttcccatactcgta

SEQ ID NO: 454559 - DNA, 503 bp, Homo sapiens
  misc_feature: HEFZJCU01A0PS7.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccaagggacaatggtcaccgt

SEQ ID NO: 454560 - DNA, 538 bp, Homo sapiens; identical to SEQ ID NO: 448861
  misc_feature: HEFZJCU01B9NYD.14.57.F02.1.454.heavy.3.raw

SEQ ID NO: 454561 - DNA, 520 bp, Homo sapiens
  misc_feature: HEFZJCU01C8SFM.49.27.C05.1.454.heavy.3.raw
agtcgagagacacgaccggtgctcgatttagacgcgatcgaagggtttgggggctctgggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtattactgtgtgaaagtacttttatgacagtagtggtttctccgagtatgcact

SEQ ID NO: 454562 - DNA, 387 bp, Homo sapiens; identical to SEQ ID NO: 445229
  misc_feature: HEFZJCU01DN22T.11.20.B09.1.454.heavy.3.raw

SEQ ID NO: 454563 - DNA, 524 bp, Homo sapiens
  misc_feature: HEFZJCU01DXKKY.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgagggggcccgatttcaccattctcccagagacaattccaagaacacgctgtttcttcaaatgaacagcctgagagccgatgacacggccgtgtattactgtgcgagagatggggcccacgaacgttactacgctatggacgtctggggccaagggaccg

SEQ ID NO: 454564 - DNA, 534 bp, Homo sapiens
  misc_feature: HEFZJCU01CFEXP.13.88.H11.1.454.heavy.3.raw
tcacgtactacacgaccggtgctcgatttagcgacagcgagaacacacaaagggggggattcccaagtgttttcattcagtgatcaggactgaacacagaggactcaccatggagtttgggctgagctggattttccttggtgtttttttaaaaggtgtccactgtgagctgcagctggtggagtctggggggggcttggtaaagcctggggggtcccttacactctcctgtgtagcctctaaaatcactttcaacgacgcctggatgagctgggtccgccaggcgccagggaggggactggagtgggttggccgtattaaagcgaggccgatggtgggacagcagacttcgctgcacccgtgcaagccagattcaccctctcaagacatgatttagagaatactgtgtatttgcaaatgaacagcttgacaaccgaggacgcaggcgtttattactgtgccagtagttccacctggccactctacttctttgacttctggggccagggaccctggtcgccgtctcctcagctt

SEQ ID NO: 454565 - DNA, 517 bp, Homo sapiens; identical to SEQ ID NO: 446039
  misc_feature: HEFZJCU01DH3UZ.9.70.G04.1.454.heavy.3.raw

SEQ ID NO: 454566 - DNA, 507 bp, Homo sapiens
  misc_feature: HEFZJCU01ESZPJ.21.4.A04.1.454.heavy.3.raw
  modified_base (454)..(454): a, c, t, g, unknown or other
tcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactgggtccgccaggctccagggaagggctggagtgggtcggccgtattacaaggaaagctaacagttacagtacagaatacggcgcgtctgtgaaaggaaggttcaccatctcaagagatgattcaaagaactcactgtatctgcaaatgaacagcctgaaaaccgnggacacggccgtgtattattgtggtagacaaaaggagtggatggtggtggtag

SEQ ID NO: 454567 - DNA, 525 bp, Homo sapiens
  misc_feature: HEFZJCU01D4N6G.49.11.A11.1.454.heavy.3.raw
agtcgagagacacgaccggtgctcgatttagctacgactgcagggggagccccagccctgggattcccagctgtttctgcttgctgatcaggactgcacacagagaactcaccatggagtttgggctgacctgggttttccttgttgctattttaaaaggtgtccagtgtgaagggcagctggtggagtccgggggaggcttggttcagcctggggggtccctaagactctcctgtgcagcctctggaatcgccttcaataagttttggatgtactgggtccgccaagttccagggaaggggctgatgtgggtctcacgtattgatgttgatgggagttacagtgaccacgcggactctgtgaagggccgattcaccgtctccagagaaaacgccaagaacacggtgtatctgcaaatgactggcctgagagccgaggacacggcagtttattactgtgcaagaggcttgtggtcgactgtcgacctggactggtacttcgatctggtggggccgtggccaccgt

SEQ ID NO: 454568 - DNA, 510 bp, Homo sapiens
  misc_feature: HEFZJCU01BVQC0.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgtcgagcgacccggggctcctcaatggctttcatttacg

SEQ ID NO: 454569 - DNA, 507 bp, Homo sapiens
  misc_feature: HEFZJCU01CPG6S.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttctggggccagggcg

SEQ ID NO: 454570 - DNA, 481 bp, Homo sapiens; identical to SEQ ID NO: 445517
  misc_feature: HEFZJCU01DYZ15.22.36.D03.1.454.heavy.3.raw

SEQ ID NO: 454571 - DNA, 510 bp, Homo sapiens
  misc_feature: HEFZJCU01CF0I9.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaagggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagctccaccaagggcccatcggtcttcccctggcaccctcctccaagagcacctctgggggcacagcggccctgggctgcctggtcaaggactacttccgagtgcgtct

SEQ ID NO: 454572 - DNA, 503 bp, Homo sapiens
  misc_feature: HEFZJCU01D4TS2.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccaagagcacctctgggggcacagcggccctgggctgcctggtcaaggactactcctacgtcgtat

SEQ ID NO: 454573 - DNA, 505 bp, Homo sapiens; identical to SEQ ID NO: 445638
  misc_feature: HEFZJCU01BBM40.11.40.D07.1.454.heavy.3.raw

SEQ ID NO: 454574 - DNA, 515 bp, Homo sapiens
  misc_feature: HEFZJCU01DPJ5G.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggtagtacatactccgcagactccgtgagggccgattcaccatctccagagacaattccaagaacacgctgtttctcaatgaacagcctgagagccgatgacacggccgtgtattactgtgcgagagatggggcccacgaacgttactacgctatggacgtctggggccaagggaccg

SEQ ID NO: 454575 - DNA, 510 bp, Homo sapiens
  misc_feature: HEFZJCU01DI5UO.9.64.F09.1.454.heavy.3.raw
tgatacgtctcacgaccggtgctcgatttagcgcgtatacaaggggctcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttgggtccgccaggctccagggaagggcctgggagtgggtggccaacataaaggaagatggaagtgagaagtcctatgtggactctgtgaagggccgattcatcatctccagagacaacgccgagaactccctgtatctgcaaatgaacagcctgagagtcgaggacacggctatgtattattgtgtgagagataaaagtggggaccagggaaccctggtcaccgtct

SEQ ID NO: 454576 - DNA, 501 bp, Homo sapiens; identical to SEQ ID NO: 447719
  misc_feature: HEFZJCU01BPSHP.17.10.A10.1.454.heavy.3.raw

SEQ ID NO: 454577 - DNA, 499 bp, Homo sapiens
  misc_feature: HEFZJCU01DQ7WY.48.57.F02.1.454.heavy.3.raw
agtatacatacacgaccggtgctcgatttagctcgatatagttgggtttggggggtctcagagaggagccttagccctggactccaaggcctttccacttggtgatcagcactgagcacagaggactcaccatggaattggggctgagctgggttttccttgttgctattttagaaggtgtccagtgtgaagtgcagctggtggagtctgggggaggcttggtccagcctggggggtccctaagactctcctgtgcagcctctggattcacctttagtacctattggatgacctggatgaacagcctgagagccgaggacgcggctgtgtattactgtgcgagagatgcgaatccctctgatagtaatggtcgttattatgatgctttgatatgtgggccaagggacaacggtcaccgtctcttcagcctccaccaaggccatcgtctcccctggcgcctgctcagagcacctccgagagcacagcggcctggctgccg

SEQ ID NO: 454578 - DNA, 509 bp, Homo sapiens
  misc_feature: HEFZJCU01BSDSD.51.43.D10.1.454.heavy.3.raw
cgatcgtatacacgaccggtgctcgatttagactagcagtaagggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccatatatttctgtgcgcgaggaatttcgacttctggaataattacttgggttggaaactaccttcattactggggccagggaaccctggtcaccgtctcctcagcctccaccaagggcccatcggtcttcccctcggcaccctcctccaagagcacctctgggggcacagcggccctgggctgcctggtcaaggactacttcctcgtagcact

SEQ ID NO: 454579 - DNA, 398 bp, Homo sapiens
  misc_feature: HEFZJCU01BR0O7.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctcccgagagcacagcggccctgggctgcctggtacaaggactacttcctacgtgagct

SEQ ID NO: 454580 - DNA, 374 bp, Homo sapiens; identical to SEQ ID NO: 444640
  misc_feature: HEFZJCU01BF99M.7.37.D04.1.454.heavy.3.raw

SEQ ID NO: 454581 - DNA, 500 bp, Homo sapiens
  misc_feature: HEFZJCU01A7J5C.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccgaggcgaggggctggagtgggtggcgtattatatcacatgatggaactaatagacgctatgccgactccgtgaagggccgattcaccatctccagagacaattccaagaacacgcagtatctgcaaatgaacagcctgagagctggaggacacggctgtgtattacgtgtgggagaggatgggaggtcgattattgta

SEQ ID NO: 454582 - DNA, 526 bp, Homo sapiens
  misc_feature: HEFZJCU01DXBKK.10.44.D11.1.454.heavy.3.raw
catagtagtgcacgaccggtgctcgatttagcgcagtacgaagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggcccgattcaccatctcccagagacaattccaggaacacaatgtatttggaaatgaacagcctaaagtcctgaggacacgggtgtatactactgtacgaaggaggggggaaccgagcgggagttccaagtactcctttgacgtctggggcctac

SEQ ID NO: 454583 - DNA, 514 bp, Homo sapiens
  misc_feature: HEFZJCU01EBE7U.9.70.G04.1.454.heavy.3.raw
tgatacgtctcacgaccggtgctcgatttagtgtagtgtgaagggaaagggcctgtgaaggcttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctggggccaggggaccaaggtcaccgtctcctcagcctccaccaagggcccatcggtcttcccctggcgccctgctccaggagcacctccgagagcacagcggccctgggctgcctggtcaaggactacttccagacgtatca

SEQ ID NO: 454584 - DNA, 509 bp, Homo sapiens
  misc_feature: HEFZJCU01BDNH2.10.53.E09.1.454.heavy.3.raw
catagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcggtcgggggaataccttcagcac

SEQ ID NO: 454585 - DNA, 519 bp, Homo sapiens
  misc_feature: HEFZJCU01DWH8F.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggggccggggaaccctggtcgccgtctcctcagcctccaccaagggcccatcggtcttcccctggccaccctcctccaagagcacctctgggggcacagcggccctgggctgcctgtcaaggactacttccagacgtatca

SEQ ID NO: 454586 - DNA, 513 bp, Homo sapiens
  misc_feature: HEFZJCU01CFTJ0.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacaggccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggaccacggccacatattactgtgcgaaagatcgtcgggctgggttccgcgggtccgggt

SEQ ID NO: 454587 - DNA, 508 bp, Homo sapiens; identical to SEQ ID NO: 448191
  misc_feature: HEFZJCU01D6X6B.4.67.G01.1.454.heavy.3.raw

SEQ ID NO: 454588 - DNA, 508 bp, Homo sapiens; identical to SEQ ID NO: 445911
  misc_feature: HEFZJCU01B15YE.12.78.H01.1.454.heavy.3.raw

SEQ ID NO: 454589 - DNA, 491 bp, Homo sapiens
  misc_feature: HEFZJCU01BAKW4.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatgggcactacatattattctgactccgtgaagggccgttcacctctccagagacacttccaacaacatcttgtattcttcacatgcacaatctgagagtcgacgacacggccacctattattgtgcgcgacatgactacgctcaattc

SEQ ID NO: 454590 - DNA, 492 bp, Homo sapiens
  misc_feature: HEFZJCU01DPH2J.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcggaattggtggcggtgactgctattgactactggggccagggaaccctggtcaccgtctcctcagcctccaccaaggccatcggtcttcccctggcaccctcctccaagagcacctctgggggcacagcggccctggctgcctggtcaaggactacttccgagtagtaca

SEQ ID NO: 454591 - DNA, 403 bp, Homo sapiens; identical to SEQ ID NO: 444540
  misc_feature: HEFZJCU01AOYI3.16.72.G06.1.454.heavy.3.raw

SEQ ID NO: 454592 - DNA, 497 bp, Homo sapiens
  misc_feature: HEFZJCU01DRAI2.40.39.D06.1.454.heavy.3.raw
tctagcgactcacgaccggtgctcgatttagtgacatctcgcagttctttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccggcagacacggctgtctattactgtgcgaggccccgagcgcagtggctttttgattgccttgatatgtgggccgaagggacaat

SEQ ID NO: 454593 - DNA, 379 bp, Homo sapiens; identical to SEQ ID NO: 444450
  misc_feature: HEFZJCU01C7ERA.47.77.G11.1.454.heavy.3.raw

SEQ ID NO: 454594 - DNA, 515 bp, Homo sapiens
  misc_feature: HEFZJCU01BQQQY.13.87.H10.1.454.heavy.3.raw
  modified_base (437)..(437): a, c, t, g, unknown or other
tcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtggtagcataggctatgcggactctgtgaagggccgattcaccatctccagagacaacgccaagaactccctgtatctgcaaatgaacancctgagagctgaggacacggccttgtattattgtgacaaagataccaaccccttacgtactttttggagttggttacg

SEQ ID NO: 454595 - DNA, 486 bp, Homo sapiens
  misc_feature: HEFZJCU01EMFH1.16.12.B01.1.454.heavy.3.raw
tgtactactccacgaccggtgctcgatttagtagtgtagatttgggcttggaacagcctggggggtccctgagactctcctgtgcaacctctggattcacctttaccagctatgccatgagctgggtccgccaggctccagggaaggggctggagtgggtcgcagccattagtggtattcgtgatgccacatactacgcagactccgtgaggggccggttcaccatctccagcgacacttccaggagcacgttgtatctgcaaatgaacagcctgagagtcgaggacacggccctatattactgtgcgaaagataagatttggggacccgatgcttatgatagctggggccaagggacaatggtcaccgtctcttcagcctccaccaagggcccatcggtcttcccctggcaccctcctccaagagcacctctgggggcacagcggccctgggctgcctggtcaaggactacttccgagtagtaca

SEQ ID NO: 454596 - DNA, 511 bp, Homo sapiens
  misc_feature: HEFZJCU01EIYZ9.49.6.A06.1.454.heavy.3.raw
  modified_base (463)..(463): a, c, t, g, unknown or other
agtcgagagacacgaccggtgctcgatttagatctactgacaggggagctctgagagaggagcccagccctgggattttcaggtgttttcatttggtgatcaggactgagcagagagaactcaccatggagtttgggctgagcggtgtcgtttctaggtcggctaattttaaaaggtgtcagtgtgaggtgcagctggtggactctgggggaggcttggtacagcctgggggtccctgagactctcctgtgcagcctctggattcacctttagcagttttgccatgggctgggtccgccaggctccagggaaggggctggagtgggtctcaactattagcggtattggtactaccacatactacgcagactccgtgaagggccgcttcaccatctccagagacaattccaagaacatggtgtttctgcaaatgagcagcctgagagccgaggcacggccgtanattctgtgcgaaagttcgcgtgtctaggtcatttgactcgtggggccg

SEQ ID NO: 454597 - DNA, 500 bp, Homo sapiens
  misc_feature: HEFZJCU01C253K.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtattttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgccttgatatgtgggccagggacaatggtcacgt

SEQ ID NO: 454598 - DNA, 524 bp, Homo sapiens; identical to SEQ ID NO: 446401
  misc_feature: HEFZJCU01DRPE0.3.82.H05.1.454.heavy.3.raw

SEQ ID NO: 454599 - DNA, 506 bp, Homo sapiens; identical to SEQ ID NO: 449588
  misc_feature: HEFZJCU01AMBB1.11.72.G06.1.454.heavy.3.raw

SEQ ID NO: 454600 - DNA, 492 bp, Homo sapiens
  misc_feature: HEFZJCU01CMBTE.43.9.A09.1.454.heavy.3.raw
tgtgagtagtcacgaccggtgctcgatttagcgagacgcgcagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggacggatgaaccctaacaatggtgccactctgtatgcacagaactttcaggacagggtcaccatgaccagggacacgtccatcaacacaggctacatggacctgagcagcctcagacctgacgacacgggcgtctatttctgtgcgagagtccctatgttgggccaactggggactttgtac

SEQ ID NO: 454601 - DNA, 477 bp, Homo sapiens; identical to SEQ ID NO: 444659
  misc_feature: HEFZJCU01C5NU6.16.10.A10.1.454.heavy.3.raw

SEQ ID NO: 454602 - DNA, 509 bp, Homo sapiens
  misc_feature: HEFZJCU01BP0L8.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgtcgagcgacccggggctcctcaatggctttcatttacg

SEQ ID NO: 454603 - DNA, 509 bp, Homo sapiens
  misc_feature: HEFZJCU01BMEG7.52.61.F06.1.454.heavy.3.raw
cgcagtacgacacgaccggtgctcgatttagctacgctctaagggaaaggggcctctactgatgaaaaccagcccagccctgaccctgcagctctgggagacgagcccagcactggaaggcgccggtgtttccattcggtgatcagcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtacaccctctggattcaccttcagcaactatgcaatgcactgggtccgcctggctcccggcaagggtctggactgggtggcaggtatatcagatgatgggaccaaaaatactacgcaaactccgtgaagggccgattcaccgtatctagagacagttccgatgacacaatctatctgcaaatgaacagcctgaaagttgacgacacggtcgtttttact

SEQ ID NO: 454604 - DNA, 537 bp, Homo sapiens; identical to SEQ ID NO: 445697
  misc_feature: HEFZJCU01DQ543.14.57.F02.1.454.heavy.3.raw

SEQ ID NO: 454605 - DNA, 500 bp, Homo sapiens
  misc_feature: HEFZJCU01BQ18H.13.15.B04.1.454.heavy.3.raw
tcacgtactacacgaccggtgctcgatttagacagtatatatccgcgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctgggggtccctgagactctcctgtgcagcctctggattcaccttcagtagctactggatgcactgggtccgccaagctccagggaagggctggtgtgggtctcacgtattaatagtgatgggagtagcacaagctacgcggactccgtgaagggccgattccaccatctccagagacaacgccaagaacacgctgtatctgcaaatgaacagtctgagagccgaggacacggctgtgtattactgtgcaaagagagtacactattaaattactatgaatagtagtgg

SEQ ID NO: 454606 - DNA, 483 bp, Homo sapiens; identical to SEQ ID NO: 450288
  misc_feature: HEFZJCU01D8CYH.19.71.G05.1.454.heavy.3.raw

SEQ ID NO: 454607 - DNA, 514 bp, Homo sapiens
  misc_feature: HEFZJCU01DW1OQ.11.13.B02.1.454.heavy.3.raw
cgagagataccacgaccggtgctcgatttagtctagcgactttgggttctccttgttgctattttagaagttgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctgcgccctgctccaggagcacctccgagagcacagcggccctgggctcg

SEQ ID NO: 454608 - DNA, 494 bp, Homo sapiens
  misc_feature: HEFZJCU01DODD0.53.7.A07.1.454.heavy.3.raw
cgcgtatacacacgaccggtgctcgatttagcacgtgtcgcaggggagctctgagagaggagccttagccctggactccagggcctatccacttggtgatcaacactgagcaccgaggattcaccatggaactggggctccgctgggttctccttgtcgctattttagaaggtgcccagtgtgaggtgcaattggtggagtctgggggaggcctggtcaggcctggggggtccctgaggctctcctgttcagactctacattcaatgtcagtgacgataatatgtactgggtccgccaggctcctggacaggggctggaatgggtcgcattccttagtcgaagtgatggttccacattctacgcagactcaatgcggggccgattcatcatctccagagacaccgccaagaacacactctttctgcagatgaacagtctgagggccgaagacacggctgtctactattgtgtgcgagagattttctggtttggc

SEQ ID NO: 454609 - DNA, 517 bp, Homo sapiens
  misc_feature: HEFZJCU01BAD1W.48.87.H10.1.454.heavy.3.raw
agtatacatacacgaccggtgctcgatttagcagtactgcgttgggtttggggatttagatgtctgtgttgggtttggggggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctgggtcaccgtctcctcagcctccaccaagggcccatcggtcttcccctggcgccctgctccaggagcacctccgagagcacagcggccctgggctgcctggtcaaggactacttcctatgtata

SEQ ID NO: 454610 - DNA, 513 bp, Homo sapiens; identical to SEQ ID NO: 446699
  misc_feature: HEFZJCU01AMOKJ.12.25.C03.1.454.heavy.3.raw

SEQ ID NO: 454611 - DNA, 529 bp, Homo sapiens; identical to SEQ ID NO: 446480
  misc_feature: HEFZJCU01BTGTU.18.33.C11.1.454.heavy.3.raw

SEQ ID NO: 454612 - DNA, 518 bp, Homo sapiens
  misc_feature: HEFZJCU01D9R3M.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctc

SEQ ID NO: 454613 - DNA, 519 bp, Homo sapiens
  misc_feature: HEFZJCU01AK9R0.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaagggagggggaaccaggcgggagttccaagtacttccg

SEQ ID NO: 454614 - DNA, 504 bp, Homo sapiens
  misc_feature: HEFZJCU01BYVTN.49.38.D05.1.454.heavy.3.raw
agtcgagagacacgaccggtgctcgatttagtatctgatagttgggtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggcccatcggtcttcccctggcg

SEQ ID NO: 454615 - DNA, 526 bp, Homo sapiens
  misc_feature: HEFZJCU01CT80F.48.28.C06.1.454.heavy.3.raw
agtatacatacacgaccggtgctcgatttagagctcacgtattgggtttgggggactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgtacacacaccatcttgacgactggggatgcttttcatttctggggccaggggaccgtggtcgccgtgtctacagcctccaccaagggcccatcggtcttccccctggca

SEQ ID NO: 454616 - DNA, 500 bp, Homo sapiens
  misc_feature: HEFZJCU01AYGBN.51.35.D02.1.454.heavy.3.raw
cgatcgtatacacgaccggtgctcgatttagcacacgatagttgggtttgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtccttcccctcggccaccctcctccaagagcacctctgggggcacgagcggcctgggctgcctggtcaaggactacttcctcgtagcact

SEQ ID NO: 454617 - DNA, 496 bp, Homo sapiens
  misc_feature: HEFZJCU01AZHXM.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcacctc

SEQ ID NO: 454618 - DNA, 530 bp, Homo sapiens
  misc_feature: HEFZJCU01EJJHI.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaacctcaacctgacgacactgccgtttatttttgtacgagagcgtcgtctgtcagtggaattgactactgggccaggaacctggtcaccgtctcctcagcctccaccaaggccc

SEQ ID NO: 454619 - DNA, 489 bp, Homo sapiens
  misc_feature: HEFZJCU01BJ470.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaggactactccgtatctctcg

SEQ ID NO: 454620 - DNA, 464 bp, Homo sapiens; identical to SEQ ID NO: 445062
  misc_feature: HEFZJCU01EQJVP.19.10.A10.1.454.heavy.3.raw

SEQ ID NO: 454621 - DNA, 511 bp, Homo sapiens
  misc_feature: HEFZJCU01DN9LA.51.5.A05.1.454.heavy.3.raw
cgatcgtatacacgaccggtgctcgatttagatagatagacaggggagtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtcctgcacctcgtgtggccccaatttggtttaccggtcacacaaaatcagggcaagtcctacgacggtctc

SEQ ID NO: 454622 - DNA, 506 bp, Homo sapiens
  misc_feature: HEFZJCU01C0T88.12.30.C08.1.454.heavy.3.raw
atacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtccccagggaagggcctggagtggattgggtacatctatcacagtgggagcacctactacatcccgtccctgaagagtcgaattacgatgtcagtaacacgtctaggaaccagttctccctgaagctgaggtctgtgactgccgcagacacggccgtctactactgtgccaggtgggctttgcgccagtggttcagagatgatcgcttcgattcgtggggccagggaattcg

SEQ ID NO: 454623 - DNA, 526 bp, Homo sapiens
  misc_feature: HEFZJCU01A911O.47.78.H01.1.454.heavy.3.raw
agctcacgtacacgaccggtgctcgatttagtgtgagtagtttgggtttggggctctctgagagtcagggacctcctgcattagcacatgaaacacctgtggttcttccgcctcctggtgacagctcccagatttgactgcctcaggaatgccgatttgaagatgtgagatgctgcctctgatcccaggactcactgcgggtttctctgttcacaggggtcctgtcccaggtgcaaccacaccactggggcgcaggactgttgaagccttcggagaccctgtccctcacctgcgctgtctgtggtgggtccttcagtgactactactgagactagatccgccagtccccagggaaggggcgtggaatggattcgacaggtcaatcattacagatccaccaactacaacccgtccctcagcagtcgagtcaccttttcgcttgacacgtccaacaaccagttttctctgaatcaaaaccccgagaccgccgcggacagcctcggcccctggggccccagtaaacccg

SEQ ID NO: 454624 - DNA, 498 bp, Homo sapiens; identical to SEQ ID NO: 445952
  misc_feature: HEFZJCU01EDWQL.11.71.G05.1.454.heavy.3.raw

SEQ ID NO: 454625 - DNA, 515 bp, Homo sapiens
  misc_feature: HEFZJCU01CZ0NI.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccaac

SEQ ID NO: 454626 - DNA, 392 bp, Homo sapiens
  misc_feature: HEFZJCU01BJL6Y.21.25.C03.1.454.heavy.3.raw
tcgtcgctcgcacgaccggtgctcgatttagtagtgtagatttgggtttggggctgccctttggttttggagatggttttctcgatgggggctgggaggcctttgttggagaccttgcacttgtactccttgccgttcagccagtcctggtgcacgacggtgaggacgctgaccacacggaacgtgctgttgaactgctcctcccgtggctttgtcttggcattatgcacctccatgccgtccacgtaccagttgaactggacactggtcaccgtctcttcagcctccaccaagggcccatcggtcttccccctggcgccctgctccaggagcacctccgagagcacagcggccctgggctgcctggtcaaggactacttcccgagcgacga

SEQ ID NO: 454627 - DNA, 523 bp, Homo sapiens
  misc_feature: HEFZJCU01EWB6U.7.71.G05.1.454.heavy.3.raw
cgtgtctctacacgaccggtgctcgatttagtgtcgtcgcaagagagaggggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccgagcgggagttccaagtactcctttgacgtcgtc

SEQ ID NO: 454628 - DNA, 511 bp, Homo sapiens
  misc_feature: HEFZJCU01COWNE.4.23.C01.1.454.heavy.3.raw
  modified_base (502)..(502): a, c, t, g, unknown or other
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggccatatattactgtgcgagagattgggccgacggaaaccttgactactggggccagggaacccnggtcaccgt

SEQ ID NO: 454629 - DNA, 499 bp, Homo sapiens
  misc_feature: HEFZJCU01BW8WF.53.8.A08.1.454.heavy.3.raw
cgcgtatacacacgaccggtgctcgatttagcatactctacaggggctgggagaggagcccagcactagaagtcggcggtgtttccattcggtgatcagcactgaacacagaggactcaccatggagtttgggctgagctgggttttcctcgttgctcttttaagaggtgtccattgtcaggtgcagttggtggagtcggggggatctgtggtccggcctgggaggtccctgagactctcctgtacagcctccggattcagcttcgagaactatggcttgcactgggtccgccaggctccaggcaaggggctggagtgggtggcagttatttcatatgattcaagtattggatattacgcagactctgttaagggccgattcaccatctccagagacaattccaagaacaccctgtatctgcaattgagcagactcacagctgaggacacggctgtgtattactgtgtgaaagacgtttatgagagtagtggttttccg

SEQ ID NO: 454630 - DNA, 492 bp, Homo sapiens
  misc_feature: HEFZJCU01ALL6M.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccggcggggctgacca

SEQ ID NO: 454631 - DNA, 520 bp, Homo sapiens; identical to SEQ ID NO: 447178
  misc_feature: HEFZJCU01CGI84.47.64.F09.1.454.heavy.3.raw

SEQ ID NO: 454632 - DNA, 508 bp, Homo sapiens
  misc_feature: HEFZJCU01BRRSM.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagaatccgtgaagggccgcttcaccatctccagagacaattccaagaacacggtgtatctgcaaatgaacagcctgagagccgaggacacggccacatattactgtgcgaaagatctcgggctggttccgcggtccgggt

SEQ ID NO: 454633 - DNA, 498 bp, Homo sapiens; identical to SEQ ID NO: 448922
  misc_feature: HEFZJCU01DLB08.11.73.G07.1.454.heavy.3.raw

SEQ ID NO: 454634 - DNA, 495 bp, Homo sapiens; identical to SEQ ID NO: 445359
  misc_feature: HEFZJCU01CVRLX.4.21.B10.1.454.heavy.3.raw

SEQ ID NO: 454635 - DNA, 479 bp, Homo sapiens; identical to SEQ ID NO: 447128
  misc_feature: HEFZJCU01AP92O.4.37.D04.1.454.heavy.3.raw

SEQ ID NO: 454636 - DNA, 506 bp, Homo sapiens; identical to SEQ ID NO: 444696
  misc_feature: HEFZJCU01CLBX8.16.34.D01.1.454.heavy.3.raw

SEQ ID NO: 454637 - DNA, 503 bp, Homo sapiens
  misc_feature: HEFZJCU01EFMYX.10.55.E11.1.454.heavy.3.raw
catagtagtgcacgaccggtgctcgatttagcactcgcacgttgggtttgggctcaactctcttgtccaccttggtgttactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagcttttgaattttggggccgaagggacaataggtcatcgtctcctctacg

SEQ ID NO: 454638 - DNA, 501 bp, Homo sapiens
  misc_feature: HEFZJCU01CXKB5.26.23.C01.1.454.heavy.3.raw
  modified_base (437)..(437): a, c, t, g, unknown or other
agactatactcacgaccggtgctcgatttagtacacgtgattagggattgggaggcgtggtccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaaataaacttcgtgagaagtgacgactcggccgtttatttttgtgcgagagaggggtacagtagcggccgagctccggcctttgaccactggggccagggaaccctggtcaccgtctcctcagcctccaccaagggcccatcggtcttcccctggcgccctgctccnggagcacctccgagagcacagcggccctgggctgcctggtcaaggactacttccagtatagtct

SEQ ID NO: 454639 - DNA, 494 bp, Homo sapiens; identical to SEQ ID NO: 445100
  misc_feature: HEFZJCU01CX97N.52.53.E09.1.454.heavy.3.raw

SEQ ID NO: 454640 - DNA, 392 bp, Homo sapiens; identical to SEQ ID NO: 444682
  misc_feature: HEFZJCU01EBH0L.16.70.G04.1.454.heavy.3.raw

SEQ ID NO: 454641 - DNA, 500 bp, Homo sapiens
  misc_feature: HEFZJCU01EFMNR.10.55.E11.1.454.heavy.3.raw
catagtagtgcacgaccggtgctcgatttagcactcgcacgttgggtttgggctcaactctcttgtccaccttggtgttactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagcttttgaattttggggccaagggacaatggtcatcgtctcctcacg

SEQ ID NO: 454642 - DNA, 508 bp, Homo sapiens; identical to SEQ ID NO: 444619
  misc_feature: HEFZJCU01DBJHN.3.81.H04.1.454.heavy.3.raw

SEQ ID NO: 454643 - DNA, 502 bp, Homo sapiens; identical to SEQ ID NO: 452487
  misc_feature: HEFZJCU01DWRLP.16.21.B10.1.454.heavy.3.raw

SEQ ID NO: 454644 - DNA, 547 bp, Homo sapiens
  misc_feature: HEFZJCU01CCO9Z.48.3.A03.1.454.heavy.3.raw
agtatacatacacgaccggtgctcgatttagagagcgtcacagggggagagaggagcccagccctgggattttcaggtgttttcacttggtgatcaggactgaacagagagaactcaccatggagtttgggctgagctggctttttcttctggccattttaaaaggtgtccagtgtgaggagcagttgtcggaatctgggggagacctggtacagccgggggggtccctgacactctcctgtgtggcctctggattcatttttagcaaccacgccattacctgggtccgccagagtccagggaagggactggacggagtcgcgggtataagtggttttagtggaagtagattatacgcagagtccgtaaggggccggttcaccatctccagagacaattccaagaacacggcatatctacaaatgaacaacctgggcgccgaagacacggccgtctattactgtgcgagatcctctactagtgccgcgaggtactttgaactctggggtcagggaaccctggtcaccgtctcctcagcctccaccac

SEQ ID NO: 454645 - DNA, 477 bp, Homo sapiens; identical to SEQ ID NO: 444659
  misc_feature: HEFZJCU01EFHAQ.16.10.A10.1.454.heavy.3.raw

SEQ ID NO: 454646 - DNA, 497 bp, Homo sapiens
  misc_feature: HEFZJCU01AECZK.53.41.D08.1.454.heavy.3.raw
cgcgtatacacacgaccggtgctcgatttagtcacgcgagaaagggaaagggtgtacacctgagactctcctgtgcagcctctggattcacgtttgatgattctgtcatgcactgggtccggcaaactccagggaagggcctggagtggctctcaggcattacttggaatagtggcagtacaggttatgcggactctgtgaagggccgattcaccatctccagagacaacagcaaggagctcctttatttacaaatggacagcctgagagttgaggacacggccgtatattactgtgtgaaagacagcggcccacctcgcagttggtattactattacgggatggacatctggggccgagggaccacggtcaccgtctcctcagcctccaccaagggcccatcggtcttcccctggcgccctgctccaggagcacctccgagacgcacagccggccctggggcctgcccggtcaaggactacttcctcgtactgtcg

SEQ ID NO: 454647 - DNA, 491 bp, Homo sapiens
  misc_feature: HEFZJCU01CADA4.49.23.C01.1.454.heavy.3.raw
agtcgagagacacgaccggtgctcgatttagtacacgtgattagggattggggtctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacagtctgagacgtgaagacacggctgtctattactgtgcgactgagatgtctta

SEQ ID NO: 454648 - DNA, 413 bp, Homo sapiens; identical to SEQ ID NO: 452062
  misc_feature: HEFZJCU01DGOWB.40.81.H04.1.454.heavy.3.raw

SEQ ID NO: 454649 - DNA, 377 bp, Homo sapiens
  misc_feature: HEFZJCU01CUPXV.49.72.G06.1.454.heavy.3.raw
agtcgagagacacgaccggtgctcgatttagctacgactgcaagggaaaggggctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttccccctggcgccctgctccaggagcacctccgacgagcacagcggccctgggctgcctggtcaaggactacttcctctctcgact

SEQ ID NO: 454650 - DNA, 496 bp, Homo sapiens
  misc_feature: HEFZJCU01CXZNV.51.86.H09.1.454.heavy.3.raw
cgatcgtatacacgaccggtgctcgatttagtgctatagacttgggtttgggagacgagcccagcactggaagtcgccggtgtttccattcggtgatcatcaccgaacacagaggactcaccatggagtttggactgagctgggttttcctcgttgctcttttaagaggtgtccagtgtcaggtgcagctggtggactctgggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaataaaattatgcagactccgtgaaggccgattcaccatctccagagacaattccaagaacactctatatttgcagatgaatagcctgagaattgaggacacggctgtgtattactgtgtgagagggtcggcatattccggtttttggt

SEQ ID NO: 454651 - DNA, 496 bp, Homo sapiens
  misc_feature: HEFZJCU01D8MJ5.12.2.A02.1.454.heavy.3.raw
  modified_base (460)..(460): a, c, t, g, unknown or other
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctgacgacacggccgtgtattactgtgcgagaggttttagngatacttattgtagtggtggtacctgctactttttc

SEQ ID NO: 454652 - DNA, 493 bp, Homo sapiens; identical to SEQ ID NO: 453100
  misc_feature: HEFZJCU01C3JRY.14.25.C03.1.454.heavy.3.raw

SEQ ID NO: 454653 - DNA, 496 bp, Homo sapiens
  misc_feature: HEFZJCU01BXZSU.10.58.F03.1.454.heavy.3.raw
catagtagtgcacgaccggtgctcgatttagtctgatcgagaagggaaaggggctgggagacgagcccagcactggaagtcgccggtgtttccattcggtgatcatcactgaacacagaggactcaccatggagtttgggctgacctgggttttcttcgttgctcttttaagaggtgtccagtgtcaggtgcagctggtggagtctgggggaggcgtggtccagcctgggaggtccctgagactctcctgtgcagcctctggattcaccttcaggacctatgcaatgcactgggttcgccaggctccaggcaaggggctggagtggctggcagttatatcatttgatggaagccataaatactacgcagactccgtgaagggccgattcaccatctccagagagaactccgagagcactctttatgtacaaatgaactacctgagagctgacgacacggctgtgtactactgtgcgagatcaggtgggggggactc

SEQ ID NO: 454654 - DNA, 482 bp, Homo sapiens; identical to SEQ ID NO: 444503
  misc_feature: HEFZJCU01EHRN2.7.10.A10.1.454.heavy.3.raw

SEQ ID NO: 454655 - DNA, 521 bp, Homo sapiens
  misc_feature: HEFZJCU01B0NFU.16.10.A10.1.454.heavy.3.raw
  modified_base (326)..(326): a, c, t, g, unknown or other
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattacngtgcgaaagatcctgaggcctataccacctcagtcagctggttcgaccctgggccaggaaccctggtcaccgtctcctcagcctccaccaacgggcccatcggtccttcccctggcaccctcctccaagacgcacctcgtgggggcacagcggccctgggctgcctggtcaaggactacttccgagtagtactac

SEQ ID NO: 454656 - DNA, 496 bp, Homo sapiens; identical to SEQ ID NO: 444697
  misc_feature: HEFZJCU01BRS65.16.37.D04.1.454.heavy.3.raw

SEQ ID NO: 454657 - DNA, 458 bp, Homo sapiens
  misc_feature: HEFZJCU01DOO4Q.53.12.B01.1.454.heavy.3.raw
cgcgtatacacacgaccggtgctcgatttagtagtgtagattccgcgggcaccttgaccaactactatttacagtggttgcgacaggtccctggacaagggcttgagtggatgggaagaatcaaccctaatgatggaagtgcaacaaatgcgctgaaatttcagggcagaataaccctgaccagggacacgtccacgagcacagtctacatggaattgagcagcctaacatctgaagacacggccatctattactgtgcgagagaatatcgttttatagtgggagctgccccaagatcgccattccactttgactactggggccagggaacactggtcaccgtctcctcagcctccaccaagggcccatcggtcttcccctggcaccctcctccaagagcacctctgggggcacagcggcctgggctgcctggtcaaggactacttcctcgtactgcg

SEQ ID NO: 454658 - DNA, 536 bp, Homo sapiens
  misc_feature: HEFZJCU01BLIYN.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatccctagaaagcgtcaactactactactacggtatggacctcgtgggaccg

SEQ ID NO: 454659 - DNA, 512 bp, Homo sapiens; identical to SEQ ID NO: 451977
  misc_feature: HEFZJCU01DYSS4.48.34.D01.1.454.heavy.3.raw

SEQ ID NO: 454660 - DNA, 491 bp, Homo sapiens; identical to SEQ ID NO: 446104
  misc_feature: HEFZJCU01DR71Y.3.34.D01.1.454.heavy.3.raw

SEQ ID NO: 454661 - DNA, 464 bp, Homo sapiens; identical to SEQ ID NO: 445553
  misc_feature: HEFZJCU01D2DXK.19.10.A10.1.454.heavy.3.raw

SEQ ID NO: 454662 - DNA, 483 bp, Homo sapiens; identical to SEQ ID NO: 444639
  misc_feature: HEFZJCU01A83YU.11.23.C01.1.454.heavy.3.raw

SEQ ID NO: 454663 - DNA, 396 bp, Homo sapiens; identical to SEQ ID NO: 444469
  misc_feature: HEFZJCU01AF76P.47.46.E02.1.454.heavy.3.raw

SEQ ID NO: 454664 - DNA, 498 bp, Homo sapiens
  misc_feature: HEFZJCU01CT7QP.19.26.C04.1.454.heavy.3.raw
tactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaatgaacagcctgagagctggggacacggctgtgtattactgtgcgagagcggctggcaactacatccatttac

SEQ ID NO: 454665 - DNA, 511 bp, Homo sapiens; identical to SEQ ID NO: 446224
  misc_feature: HEFZJCU01C1UWD.7.28.C06.1.454.heavy.3.raw

SEQ ID NO: 454666 - DNA, 494 bp, Homo sapiens; identical to SEQ ID NO: 447658
  misc_feature: HEFZJCU01DE4WP.4.21.B10.1.454.heavy.3.raw

SEQ ID NO: 454667 - DNA, 532 bp, Homo sapiens; identical to SEQ ID NO: 445228
  misc_feature: HEFZJCU01EEH7L.7.78.H01.1.454.heavy.3.raw

SEQ ID NO: 454668 - DNA, 396 bp, Homo sapiens; identical to SEQ ID NO: 444426
  misc_feature: HEFZJCU01EC4HP.18.31.C09.1.454.heavy.3.raw

SEQ ID NO: 454669 - DNA, 482 bp, Homo sapiens
  misc_feature: HEFZJCU01DH6O4.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggcctgggctgcctggtcaaggactacttcccactactatg

SEQ ID NO: 454670 - DNA, 497 bp, Homo sapiens
  misc_feature: HEFZJCU01EKZS9.40.81.H04.1.454.heavy.3.raw
tctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctggaccactc

SEQ ID NO: 454671 - DNA, 508 bp, Homo sapiens; identical to SEQ ID NO: 451852
  misc_feature: HEFZJCU01D8D0J.5.41.D08.1.454.heavy.3.raw

SEQ ID NO: 454672 - DNA, 532 bp, Homo sapiens
  misc_feature: HEFZJCU01C160C.12.12.B01.1.454.heavy.3.raw
  modified_base (492)..(492): a, c, t, g, unknown or other
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtggattgggagtatctattttagcgggagcacctaccagaacgcgtccctcaagagtcgaatcaccatgtcggtggacacatcgaagaaccagatctcccttaagtgaggtctgtgaccgccggctgacacggccgtctattactgtgcgagagtccgtgctgaagaactacttttttgtacttattggggccagggaatccgtggtcnccgtcgcctcagcctccaccaaggcccatcgtcttccccg

SEQ ID NO: 454673 - DNA, 509 bp, Homo sapiens
  misc_feature: HEFZJCU01EE8H4.49.81.H04.1.454.heavy.3.raw
agtcgagagacacgaccggtgctcgatttagtagtgtagattcgcggggagctctgggagaggaacccagcactagaagtcggcggtgtttccattcggtgatcaacactgaacacagaggactcaccatggagtttgggctgagcgtggtttcgtcgtaggctctttaagtaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagctccgtgaagggccgattcaccatctccagagacaattccaaagaacacgctatatttgcacatgaacagcctgagagctgaggcacggctatttattactgtgcgaacttaatcacggaggacaaggggtgacccccgt

SEQ ID NO: 454674 - DNA, 510 bp, Homo sapiens
  misc_feature: HEFZJCU01DYVNT.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactgggccagggaaccctggtcgtccg

SEQ ID NO: 454675 - DNA, 395 bp, Homo sapiens
  misc_feature: HEFZJCU01B529I.48.60.F05.1.454.heavy.3.raw
agtatacatacacgaccggtgctcgatttagtacgtcatcagggaaaggggctggagtgggtctcatccattagtagtagcagtaattatatggacgacgcagactcagtgaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctgggggcacagcggccctgggctgcctggtcaaggactacttcctatgtatact

SEQ ID NO: 454676 - DNA, 515 bp, Homo sapiens
  misc_feature: HEFZJCU01CYJN0.13.43.D10.1.454.heavy.3.raw
tcacgtactacacgaccggtgctcgatttagactagcagtaaggggctgggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttcgactctcctgtgcagcctctggaatcactttcagtgacgcctggatgaactgggtccgccaggctccagggaaggggctggagtggattggccgtattaaaagtgagcctgatggtgggacaacagactacgctgcacccgtgaagggcagattcaccatctccagagatgattcaaggaacacagtgtttctgcaaatgaacagcctgactgccggggacactgccgtgtattactgtgccagcagcagtacctggccactattattttttgactttctc

SEQ ID NO: 454677 - DNA, 465 bp, Homo sapiens
  misc_feature: HEFZJCU01DM91Q.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggcccatcggtccttcccctggcgccctgctccaggagcacctccgagagcacagcggccctgggctgcctggtcaaggactacttcccacgagagta

SEQ ID NO: 454678 - DNA, 478 bp, Homo sapiens; identical to SEQ ID NO: 448105
  misc_feature: HEFZJCU01DGRQE.26.78.H01.1.454.heavy.3.raw

SEQ ID NO: 454679 - DNA, 479 bp, Homo sapiens
  misc_feature: HEFZJCU01BYVA9.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggttggacgtctggggccaagggccacggtcatcgtctcctcagcctccaccaagggcccatcggtcttcccctggcaccctcctccaagagcacctctgggggcacagcggccctgggctgcctggtcaggactacttccgtatctctc

SEQ ID NO: 454680 - DNA, 516 bp, Homo sapiens
  misc_feature: HEFZJCU01BRUTT.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactggtgggagtccctggctggcacctgtatccgaccgttggagtcagggaactctggtcaccgtctcctcagcctccaccaagggcccatcggtcttccccctggccgccctgcctccaggagcacctccgagagcacagccggccctggg

SEQ ID NO: 454681 - DNA, 502 bp, Homo sapiens
  misc_feature: HEFZJCU01CGM0K.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctgggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtggaatgaacagtctgagagcgagaacacggctctctattactgtgcgagagaccccgaaatagggtactacg

SEQ ID NO: 454682 - DNA, 540 bp, Homo sapiens
  misc_feature: HEFZJCU01BGYOQ.15.86.H09.1.454.heavy.3.raw
tctacgtagccacgaccggtgctcgatttagtgctatagacttgggtttgggggggagagggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaagtaaaatgatggtgagaaaatagactacggtgcacccgtgaaaggaagattcaccatctcaagagataattcaaaacgacggtgtatttgcaaatgaacagcctgaaaaccgaggacacagccgtctattactgtaccacagattcggaagtgcatcgacgtaaaggaggctatgcttttgatatctggggcccaggac

SEQ ID NO: 454683 - DNA, 316 bp, Homo sapiens; identical to SEQ ID NO: 444444
  misc_feature: HEFZJCU01A7M2Z.47.56.F01.1.454.heavy.3.raw

SEQ ID NO: 454684 - DNA, 421 bp, Homo sapiens; identical to SEQ ID NO: 448553
  misc_feature: HEFZJCU01BUR6K.16.78.H01.1.454.heavy.3.raw

SEQ ID NO: 454685 - DNA, 488 bp, Homo sapiens
  misc_feature: HEFZJCU01CG2VA.40.85.H08.1.454.heavy.3.raw
tctagcgactcacgaccggtgctcgatttagtatcactcagtcgcggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccagggaaccctggtcaccgtctcctcagcctccaccaagggcccatcggtcttcccctggcgccctgctccaggagcacctccgagagcacagcggccctggctgcctggtcaaggactacttcagtcgctaga

SEQ ID NO: 454686 - DNA, 516 bp, Homo sapiens; identical to SEQ ID NO: 448668
  misc_feature: HEFZJCU01BCNME.19.86.H09.1.454.heavy.3.raw

SEQ ID NO: 454687 - DNA, 506 bp, Homo sapiens; identical to SEQ ID NO: 449588
  misc_feature: HEFZJCU01A2TIU.11.72.G06.1.454.heavy.3.raw

SEQ ID NO: 454688 - DNA, 399 bp, Homo sapiens; identical to SEQ ID NO: 451078
  misc_feature: HEFZJCU01BDBQG.47.24.C02.1.454.heavy.3.raw

SEQ ID NO: 454689 - DNA, 502 bp, Homo sapiens; identical to SEQ ID NO: 451203
  misc_feature: HEFZJCU01A3TRL.10.38.D05.1.454.heavy.3.raw

SEQ ID NO: 454690 - DNA, 483 bp, Homo sapiens
  misc_feature: HEFZJCU01ETMPD.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctcccgagagcacagcggcccgtgggctcgcctggtcaaggactacttccagacgtatca

SEQ ID NO: 454691 - DNA, 514 bp, Homo sapiens
  misc_feature: HEFZJCU01C5JDE.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacaatgaccaacgtgaagcctgcggacacggccacatattattgtgcacaccgacgctataccgccagctgggaaatcgacaactggttcgacccctgggccagggaacccttgtcaccgtctcctcagcctccaccaaggccc

SEQ ID NO: 454692 - DNA, 536 bp, Homo sapiens
  misc_feature: HEFZJCU01B2AD5.19.10.A10.1.454.heavy.3.raw
tactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccggggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactgggggacggggggaaaattggggccaggggaaccctggtctccgtctcgtca

SEQ ID NO: 454693 - DNA, 525 bp, Homo sapiens; identical to SEQ ID NO: 445545
  misc_feature: HEFZJCU01ERWE1.12.86.H09.1.454.heavy.3.raw

SEQ ID NO: 454694 - DNA, 538 bp, Homo sapiens
  misc_feature: HEFZJCU01EOCO5.52.35.D02.1.454.heavy.3.raw
cgcagtacgacacgaccggtgctcgatttagcacacgatagttgggtttgggctgagctggctctttcttgtggctattttaaaaggtgtccagtgtgacgtacagctggtggagtcggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttattactgtgcgaaagatcgaggtcgcatgacagtttttggagtggccaaagacggcaggttccgctacgggttggacgtctggggccaagggaccacggtcaccgtcgcctcagcctccaccaagggcccatcggtcttcccctcggcaccctcctccaag

SEQ ID NO: 454695 - DNA, 528 bp, Homo sapiens
  misc_feature: HEFZJCU01BPEF0.40.61.F06.1.454.heavy.3.raw
tctagcgactcacgaccggtgctcgatttagctacgctctaagggaaaggggagctctgggagaggagccccagccctgagattcccatgtgtttccattcagtgatcagcactgcacacagaggactcgccatggagtttgggctgagctgggttttccttgttgctattttaaaaggtgtccagtgtgaagtgcacctggtggaatgggtctctgctattaattggaatggcggtagtggacattatgcagactctgtgaggggccgtttcaccatctccagagacaacgccaagaactccctgtatctgcaaatgaacagtctgaaagtcgaggacacggccttctattactgtgtgagagatgggatgtggcacctgtccctccacacaaattggggccagggaaccctggtcaccgtctcctcagcctccaccaagggcccactcggtccttccccctcggccaccctccctcccaagagccacctctcggggggcacagccggcccgtggggcctggccttc

SEQ ID NO: 454696 - DNA, 503 bp, Homo sapiens
  misc_feature: HEFZJCU01D6YSH.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccatatatttctgtgcgcgaggaatttcgacttctggaataattacttgggttggaactacctt

SEQ ID NO: 454697 - DNA, 519 bp, Homo sapiens
  misc_feature: HEFZJCU01C2AHZ.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctgggggccaagggaccacggtcatcgtctccccagcctccaccaacgggcccatcggtccttccccctcggccgccctgcctcccaggagca

SEQ ID NO: 454698 - DNA, 476 bp, Homo sapiens; identical to SEQ ID NO: 444967
  misc_feature: HEFZJCU01CW8GL.16.10.A10.1.454.heavy.3.raw

SEQ ID NO: 454699 - DNA, 509 bp, Homo sapiens
  misc_feature: HEFZJCU01BK1ZC.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttctgggggccagggacg

SEQ ID NO: 454700 - DNA, 522 bp, Homo sapiens
  misc_feature: HEFZJCU01D34SQ.12.71.G05.1.454.heavy.3.raw
  modified_base (467)..(467): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccagggtcaccgtctcctcagcctccaccaagggcccatccgtcttccccctggccgcctgctccagngcacctccgagagcacagcggccctgggctgcctggtcaaggactacttcctacg

SEQ ID NO: 454701 - DNA, 513 bp, Homo sapiens
  misc_feature: HEFZJCU01BYR8H.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatacctactttgactactggggtaccg

SEQ ID NO: 454702 - DNA, 502 bp, Homo sapiens
  misc_feature: HEFZJCU01CJY08.13.11.A11.1.454.heavy.3.raw
tcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtctgggggaggtgtggtacggcctggggggtccctcagactctcctgtgcaacctctggattcagatttgatgagtatggcatacactgggtccgccaacctccagggaaggggctgcagtgggtctctggtataaactggaatggtgccagcacaacttatgcagactctgtgaagggccgattcaccatctccagagacagtgccgagaactccgtacatctgcaaatgaacagtctcggagtcgaggacacggccttgtatttctgtgcgaggttagcagtggctggtacttacggct

SEQ ID NO: 454703 - DNA, 527 bp, Homo sapiens; identical to SEQ ID NO: 450092
  misc_feature: HEFZJCU01EUDI9.18.33.C11.1.454.heavy.3.raw

SEQ ID NO: 454704 - DNA, 499 bp, Homo sapiens
  misc_feature: HEFZJCU01EDMS1.10.34.D01.1.454.heavy.3.raw
catagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactggtccgccaggctccagggaaggggctggagtgggttggccatattaaaatcaaagctgatggtgggacaacagagcacgctgcacccgtgaaaggcagattcagcatctcaagagatgattcaaaaagtacgctgtatctgaacatgaacagcctgaaaacggaggacacagccgtgtattactgtgccactcaggaccgatattgtt

SEQ ID NO: 454705 - DNA, 512 bp, Homo sapiens; identical to SEQ ID NO: 445688
  misc_feature: HEFZJCU01CERRV.3.34.D01.1.454.heavy.3.raw

SEQ ID NO: 454706 - DNA, 409 bp, Homo sapiens; identical to SEQ ID NO: 444519
  misc_feature: HEFZJCU01EEXF4.3.41.D08.1.454.heavy.3.raw

SEQ ID NO: 454707 - DNA, 511 bp, Homo sapiens
  misc_feature: HEFZJCU01CXD1P.48.75.G09.1.454.heavy.3.raw
agtatacatacacgaccggtgctcgatttagtatagacatcagggggactcctgtgccccaccatggacacactttgctccacgctcctgctgctgaccatcccttcatgggtcttgtcccagatcaccttgaaggagtctggtcctacgctggtgaaacccacacagaccctcacactgacctgcaccttctcgggcttctcactcactcgtagtggggaggctgtggcctggattcgtcagcccccagggaaggccctggagtggcttgctctcatttactgggatactgatgaccgctacactccagctctgaaaacaggctcaccatcgccatggacacctccaaaaacaggtggtccttaaaatgaccaacatggacccaatggacagcgcgacatattactgtgcacacattgattgtggtcccaccaggtgtcccgggccctttgatatcgtggggccgggggacattcgtcaccgtctctgcagcctccaccaagggcccacg

SEQ ID NO: 454708 - DNA, 400 bp, Homo sapiens; identical to SEQ ID NO: 444452
  misc_feature: HEFZJCU01AFHJJ.47.24.C02.1.454.heavy.3.raw

SEQ ID NO: 454709 - DNA, 483 bp, Homo sapiens; identical to SEQ ID NO: 450288
  misc_feature: HEFZJCU01BG2YO.19.71.G05.1.454.heavy.3.raw

SEQ ID NO: 454710 - DNA, 538 bp, Homo sapiens
  misc_feature: HEFZJCU01CZUM8.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttattggggccaggggagcccctggtcctaccg

SEQ ID NO: 454711 - DNA, 395 bp, Homo sapiens; identical to SEQ ID NO: 444517
  misc_feature: HEFZJCU01E02WP.16.68.G02.1.454.heavy.3.raw

SEQ ID NO: 454712 - DNA, 507 bp, Homo sapiens; identical to SEQ ID NO: 450163
  misc_feature: HEFZJCU01EH6R2.16.21.B10.1.454.heavy.3.raw

SEQ ID NO: 454713 - DNA, 492 bp, Homo sapiens
  misc_feature: HEFZJCU01D0WC9.53.26.C04.1.454.heavy.3.raw
cgcgtatacacacgaccggtgctcgatttagtctagcgactttgggtttgggggagcatcaccctgcaaccacagctgtcctctagagaatccccagagagctccgttcctcaccatggactggacctggaggatcctctttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacagggccatcagaacagcctacatggagctgaacagactgacatctgacgacacggccgtttattattgtgtgagagaggacccgatgactc

SEQ ID NO: 454714 - DNA, 525 bp, Homo sapiens
  misc_feature: HEFZJCU01A2LNA.9.30.C08.1.454.heavy.3.raw
tgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctcctggaggtgacctctgtgactgccgcagactcggccgtgtatttctgtgccagaacgcaaagcagcgcctactatactttaaactttgacttctggggccagggatccctggtcaccgtctcctcagcctcc

SEQ ID NO: 454715 - DNA, 501 bp, Homo sapiens; identical to SEQ ID NO: 445999
  misc_feature: HEFZJCU01D8AMT.12.38.D05.1.454.heavy.3.raw

SEQ ID NO: 454716 - DNA, 493 bp, Homo sapiens
  misc_feature: HEFZJCU01CH9KO.49.33.C11.1.454.heavy.3.raw
agtcgagagacacgaccggtgctcgatttagagtgagctcgttgggtttggggtctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaagggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattacctgtgcgactgagatgtcttt

SEQ ID NO: 454717 - DNA, 533 bp, Homo sapiens
  misc_feature: HEFZJCU01AZXU0.53.78.H01.1.454.heavy.3.raw
cgcgtatacacacgaccggtgctcgatttagtgtgagtagtttgggtttgggctcaactcccaggtccagttggtgcagtctggggctgagttgaagaagcctgggtcctcggtgaaggtctcctgcaagtattctggaggcaccttcaacaactatggtatcagctgggtgcgacaggcccctggacaagggcttgagtggatgggaagggtcacccctatttttgatgaagcagactctgcacagaagttccagggcagattaacgattacggcggacaagtccacgactaccgcctacatggagctgaccagtctgaaatctgaggacacggccctttattactgtgcgagatataccgtgggggttacggcggagatatcgccatactacttcgactactggggccagggaaccctgatcaccgtctcctcagcctccaccaagggcccatcggtcttcccctggcaccctcctccaagagcacctctgggggcacagcggccctgggctgcctggtcaaggactactt

SEQ ID NO: 454718 - DNA, 455 bp, Homo sapiens
  misc_feature: HEFZJCU01B00HD.52.78.H01.1.454.heavy.3.raw
cgcagtacgacacgaccggtgctcgatttagtgtgagtagtttgggtttggggggaagaggaagactgacggtccccccaggagttcaggtgctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttccccctggcaccctcctccaagagcacctctgggggcacagcggccctgggctgccctggtcaaggactacttcctatacgatcg

SEQ ID NO: 454719 - DNA, 498 bp, Homo sapiens
  misc_feature: HEFZJCU01A7UDZ.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtcgtgggggaggcttggtacagccgtggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagtagtttaggggaatgaccacgtc

SEQ ID NO: 454720 - DNA, 525 bp, Homo sapiens; identical to SEQ ID NO: 449231
  misc_feature: HEFZJCU01COJSE.9.78.H01.1.454.heavy.3.raw

SEQ ID NO: 454721 - DNA, 491 bp, Homo sapiens; identical to SEQ ID NO: 451549
  misc_feature: HEFZJCU01DGW0M.49.17.B06.1.454.heavy.3.raw

SEQ ID NO: 454722 - DNA, 517 bp, Homo sapiens
  misc_feature: HEFZJCU01C6GJ8.13.71.G05.1.454.heavy.3.raw
tcacgtactacacgaccggtgctcgatttagtgtcgtcgcaagagagaggagccttagccctggactccaaggcctttccacttggtgatcagcactgagcacagaggactcaccatggaattggggctgagcgtgggttttccttgttgctattttagaaggtgtccagtgtgaggtgcagctggtggagtctggggggggcttggtccagcctggggggtccctgagactctcctgtgcagcctctggattcacttttagtaggtattggatgggttgggtccgccagactccagagaagggactggagtgggtgggcaacataaaggaagatggaagtgaaagatactatgtggactctgtgaagggccgattcaccatctccagagacaacgccaagaactcactgtatctgcagatgaccagcctgagagtcgaggatacggctgtgtattattgttgcgagagatgggggcacggacatttttgtagaggtgtactgggggccaggggacc

SEQ ID NO: 454723 - DNA, 491 bp, Homo sapiens; identical to SEQ ID NO: 444803
  misc_feature: HEFZJCU01EQYJY.4.57.F02.1.454.heavy.3.raw

SEQ ID NO: 454724 - DNA, 401 bp, Homo sapiens
  misc_feature: HEFZJCU01AF6X6.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagacgcacagcggccctgggctgcctggtcaaggactacttcctacgtgagct

SEQ ID NO: 454725 - DNA, 522 bp, Homo sapiens
  misc_feature: HEFZJCU01AVJM1.49.20.B09.1.454.heavy.3.raw
agtcgagagacacgaccggtgctcgatttagtgtagtgtgaaggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactggggccaggggaaccccggtcgaccgtctcctctgcctccaccaac

SEQ ID NO: 454726 - DNA, 516 bp, Homo sapiens
  misc_feature: HEFZJCU01CXPSP.49.76.G10.1.454.heavy.3.raw
agtcgagagacacgaccggtgctcgatttagtcactcatacagggaaaggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcagtagtaattactactggggctgggtccgccagcccccagggaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcag

SEQ ID NO: 454727 - DNA, 505 bp, Homo sapiens; identical to SEQ ID NO: 445664
  misc_feature: HEFZJCU01BUK4M.12.33.C11.1.454.heavy.3.raw

SEQ ID NO: 454728 - DNA, 534 bp, Homo sapiens
  misc_feature: HEFZJCU01EJXQM.52.73.G07.1.454.heavy.3.raw
cgcagtacgacacgaccggtgctcgatttagctctacgctcagggggctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaagtgaggtctgttaccgccgcggacacggctgtctattactgtgcgaaaggccctcacgatgaaactacgccctggcgctatggacgtctggggccaagggaccacggtcaccgtctcctcagcctccaccaagggcccatcggtcttcccctgg

SEQ ID NO: 454729 - DNA, 419 bp, Homo sapiens
  misc_feature: HEFZJCU01D9OA7.7.31.C09.1.454.heavy.3.raw
cgtgtctctacacgaccggtgctcgatttagacgtctcatcaaggaaggaaggggctggagtgggtctcatccattagtagtagtagtagtttcatatactatgcagactcagtgaagggccgattcaccatctccagagacaacgccaagaactcactgtttctgcaaatgaacagcctgagagccgaggacacggctgtgtattactgtgcgagaccgcggatcagtgatactagtgtttattactaccgacgggattactacgctatggacgtctggggccaggggaccacggtcaccgtctcctcagcctccaccaagggcccatcggtcttcccctggcgccctgctccaggagcacctccgagagcacagcggccctgggctgcctggtcaaggactacttcctagagacacg

SEQ ID NO: 454730 - DNA, 508 bp, Homo sapiens
  misc_feature: HEFZJCU01BVA9N.11.40.D07.1.454.heavy.3.raw
cgagagataccacgaccggtgctcgatttagtgatagagcgtaacaacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcatcttcaatacctttggcatgcactgggtccgccaggctccaggcaagggactgggagtggctatcatttatgtcatttgatggaactaatatatactattctggggccgttaagggtcgattcaccatctccagagacaattccaggaacacgctgtatctgcaattacacagcccgacaactgacgacacggctgtttattactgtgccacagatatacgcgaatttagcgaggggtggccagtacagtcatacatttgaccaactggggccagggaaccctggtcatcgtctcctcagcctccaccg

SEQ ID NO: 454731 - DNA, 497 bp, Homo sapiens
  misc_feature: HEFZJCU01B4IL0.4.19.B08.1.454.heavy.3.raw
agcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggaggcgtggtccagcctgggaggtccctgagactctcctgtatagcctctggattcaccttcggcagttatgctatgcactgggtccgccaggctccaggcaaggggttggagtgggtggcagcaatatcatatgatggaagtgataaatattacatagagtccgtgaagggtcgattcaccatctccagagacaatcgcaagaacacactgtatctggaaatgaccagcctgagaggtgacgacacgggtgtttattactgtgcgcgggatagaggctcatcgtggatacaact

SEQ ID NO: 454732 - DNA, 518 bp, Homo sapiens; identical to SEQ ID NO: 449255
  misc_feature: HEFZJCU01C5K9X.3.17.B06.1.454.heavy.3.raw

SEQ ID NO: 454733 - DNA, 496 bp, Homo sapiens; identical to SEQ ID NO: 452977
  misc_feature: HEFZJCU01CFW8V.49.82.H05.1.454.heavy.3.raw

SEQ ID NO: 454734 - DNA, 537 bp, Homo sapiens
  misc_feature: HEFZJCU01EB8NV.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattgggggccaggggagccctggtcaccg

SEQ ID NO: 454735 - DNA, 494 bp, Homo sapiens
  misc_feature: HEFZJCU01AN0GR.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagcgtggtttcgtgtagctctttaaagtgtcagtgtgaggtgcaggtagtggagtccgggggaggcttagttcagcctggggatccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgtttcgatgccttcgtccgcggacttctgggccaggaa

SEQ ID NO: 454736 - DNA, 396 bp, Homo sapiens; identical to SEQ ID NO: 444426
  misc_feature: HEFZJCU01DVV72.18.31.C09.1.454.heavy.3.raw

SEQ ID NO: 454737 - DNA, 510 bp, Homo sapiens; identical to SEQ ID NO: 453756
  misc_feature: HEFZJCU01EFM5F.47.55.E11.1.454.heavy.3.raw

SEQ ID NO: 454738 - DNA, 516 bp, Homo sapiens
  misc_feature: HEFZJCU01EUDYJ.40.20.B09.1.454.heavy.3.raw
tctagcgactcacgaccggtgctcgatttagtgtagtgtgaagggggagagaggagccttagccctggattccaaggcctatccacttggtgatcagcactgagcaccgaggagtcaccatggaactgggactccgctgggttttccttgttgcgattttagaaggtgtcaagtgtgaggtgcgactggtcgagtctgggggaggcctggtcaagccgggggggtccctgagactctcctgtgcagcctctggactcaccttcaggagtttcagtatgaattgggtccgccaggctccagggaaggggctggagtgggtctcatccatcagcagtggtagcacttacatacactatgcagactcagtgaagggccgattcaccatctccagagacaacgccgggaactccctgtatctgcaaatgaagagcctgcgagccgaggacacgggtgtttattattgtactaaaggacaaaggagggactttggggagtactactacggtatgggacgtc

SEQ ID NO: 454739 - DNA, 506 bp, Homo sapiens; identical to SEQ ID NO: 444696
  misc_feature: HEFZJCU01AVM61.16.34.D01.1.454.heavy.3.raw

SEQ ID NO: 454740 - DNA, 506 bp, Homo sapiens; identical to SEQ ID NO: 446520
  misc_feature: HEFZJCU01DFHNA.10.38.D05.1.454.heavy.3.raw

SEQ ID NO: 454741 - DNA, 400 bp, Homo sapiens; identical to SEQ ID NO: 444452
  misc_feature: HEFZJCU01D1RSV.47.24.C02.1.454.heavy.3.raw

SEQ ID NO: 454742 - DNA, 396 bp, Homo sapiens; identical to SEQ ID NO: 444469
  misc_feature: HEFZJCU01BUAKN.47.46.E02.1.454.heavy.3.raw

SEQ ID NO: 454743 - DNA, 497 bp, Homo sapiens
  misc_feature: HEFZJCU01CLAMJ.10.71.G05.1.454.heavy.3.raw
catagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggctac

SEQ ID NO: 454744 - DNA, 517 bp, Homo sapiens
  misc_feature: HEFZJCU01B2WGP.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggcctgggctgcctggtcaggactacttccagacgtatca

SEQ ID NO: 454745 - DNA, 373 bp, Homo sapiens
  misc_feature: HEFZJCU01D0KW3.49.30.C08.1.454.heavy.3.raw
agtcgagagacacgaccggtgctcgatttagtctgacgtcaaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcgcctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 454746 - DNA, 516 bp, Homo sapiens
  misc_feature: HEFZJCU01AJ4WD.48.58.F03.1.454.heavy.3.raw
agtatacatacacgaccggtgctcgatttagtctgatcgagaagggaaagggggctctgggagaggagccccagccctgagattcccaggtgtttccattcagtgatcagcactgaacacagaggactcaccatggagttgggactgaactggattttccttttggctattttaaaaggtgtccagtgtgaactgcaactggtggagtctgggggaggcttggtacagcctggcaggtccctgagactctcctgtgcagcctctggattcacctttggtgattatgccatgcactgggtccggcaagctccagggaagggcctggagtgggtctcaggtattagttggaatagtgatagcataggctatgcggactctgtgaagggccgattcaccatctccagagacaacgccaagaactccctgtatctgcaaatgaacagtctgagaactgaggacacggccttgtattactgtgtaaaagataatgatttttggggttcggggtagttggga

SEQ ID NO: 454747 - DNA, 508 bp, Homo sapiens
  misc_feature: HEFZJCU01ATVNS.12.30.C08.1.454.heavy.3.raw
atacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtcccccagggaagggcctggagtggattgggtacatctatcacagtgggagcacctactacatcccgtccctgaagagtcgaattacgatgtcagtaaacacgtctaggaaccagttctccctgaagctgaggtctgtgactgccgcagacacggccgtctactactgtgccaggtgggctttgcgccagtggttcagagatgatcgcttcgattcgtggggccagggaattcg

SEQ ID NO: 454748 - DNA, 517 bp, Homo sapiens
  misc_feature: HEFZJCU01EUSD6.49.78.H01.1.454.heavy.3.raw
agtcgagagacacgaccggtgctcgatttagtgtgagtagtttgggtttgggggctctgggagaggagcccagcactagaagtcggcggtgtttccattcggtgatcagcactgaacacagaggactcaccatggagtttgggctgagctgggttttcctcgttgctcttttaagaggtgtccattgtcaggtgcagttaatggagtcggggggatctgtggtccggcctgggaggtccctgagactctcctgtgcagcctccggattcaacttcgggaactatggcttacactgggtccgccaggctccaggcaaggggctggagtgggtggcagttatttcatatgattcaagtattggatattacgcagagtccgttaagggccgattcaccatctccagagacaattccaagaacaccctgtatctgcaattgaacagactcagagctgaggacacggctgtgtattattgtgtgaaagacgtttatgagagtaatggtttttccgagtatgc

SEQ ID NO: 454749 - DNA, 532 bp, Homo sapiens
  misc_feature: HEFZJCU01EAKRU.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaagggcccatcggtcttccccctggcaccctcctccaagagcacctctgggggcacagcggccctgggctgcct

SEQ ID NO: 454750 - DNA, 501 bp, Homo sapiens
  misc_feature: HEFZJCU01COE68.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttcgt

SEQ ID NO: 454751 - DNA, 384 bp, Homo sapiens; identical to SEQ ID NO: 444454
  misc_feature: HEFZJCU01BKOV6.11.61.F06.1.454.heavy.3.raw

SEQ ID NO: 454752 - DNA, 526 bp, Homo sapiens
  misc_feature: HEFZJCU01CF6TC.53.10.A10.1.454.heavy.3.raw
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccagggggacctttggggtttcgacccctggggccagggaaccctggtcaccgtctcctcagcctccaccaagggcccatcggtcttccccctggcaccctcctccaagagcacctcg

SEQ ID NO: 454753 - DNA, 491 bp, Homo sapiens; identical to SEQ ID NO: 445067
  misc_feature: HEFZJCU01CX6Z9.4.28.C06.1.454.heavy.3.raw

SEQ ID NO: 454754 - DNA, 525 bp, Homo sapiens
  misc_feature: HEFZJCU01AVV0L.12.40.D07.1.454.heavy.3.raw
atacgacgtacacgaccggtgctcgatttagtgatagagcgtaacaacagagggctcaccatggagtttgggctgagcgtgggttttcctcgttagctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggccctggtcatcgtctccccagccctccaccaagggcccatcggtccttcccctggccg

SEQ ID NO: 454755 - DNA, 502 bp, Homo sapiens; identical to SEQ ID NO: 450016
  misc_feature: HEFZJCU01EUE7X.17.10.A10.1.454.heavy.3.raw

SEQ ID NO: 454756 - DNA, 544 bp, Homo sapiens
  misc_feature: HEFZJCU01CV8Y5.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgaggagggacggactacgggtgacctactggggggttccgaccccgttgggggcccaggggaaccctgggtccaccggtctccctcagccctccgaacccg

SEQ ID NO: 454757 - DNA, 469 bp, Homo sapiens; identical to SEQ ID NO: 449151
  misc_feature: HEFZJCU01CH1V2.4.36.D03.1.454.heavy.3.raw

SEQ ID NO: 454758 - DNA, 510 bp, Homo sapiens
  misc_feature: HEFZJCU01BPQJQ.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaacgggcccatcggtcttcccctggcaccctcctccaagagcacctctgggggcacagcggccctgggctgcctggtcaaggactacttcctacgtcgtat

SEQ ID NO: 454759 - DNA, 402 bp, Homo sapiens; identical to SEQ ID NO: 444815
  misc_feature: HEFZJCU01B0JHY.11.70.G04.1.454.heavy.3.raw

SEQ ID NO: 454760 - DNA, 514 bp, Homo sapiens
  misc_feature: HEFZJCU01BTFE5.49.58.F03.1.454.heavy.3.raw
agtcgagagacacgaccggtgctcgatttagtctgatcgagaagggaaagggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcctagttcagcctggggggtccctgagactctcctgtgcagcctctggattcaccttcagtagctactggatggactgggtccgccaagctccagggaagggctggtgtgggtctcacgtattaatagtgatgggagtagaaaaagctacgcggactccgtgaagggccgattctccatctccagagacaacgccaagaacacgctgtatctgcaaatgaacagtctgagagccgaggaaacggctgtgtattactgtgcaggtatcgaccgcgacaacaaaattcgagatacagcccagtgactacgtc

SEQ ID NO: 454761 - DNA, 391 bp, Homo sapiens; identical to SEQ ID NO: 448048
  misc_feature: HEFZJCU01D0L9Y.40.30.C08.1.454.heavy.3.raw

SEQ ID NO: 454762 - DNA, 510 bp, Homo sapiens; identical to SEQ ID NO: 445542
  misc_feature: HEFZJCU01DHDUE.16.21.B10.1.454.heavy.3.raw

SEQ ID NO: 454763 - DNA, 517 bp, Homo sapiens
  misc_feature: HEFZJCU01BSAZL.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaatgaacagcctgagaaccgacgacacggccgtctattattgtgtcatagacctaggatacaacgacggtggtacctggtattc

SEQ ID NO: 454764 - DNA, 492 bp, Homo sapiens
  misc_feature: HEFZJCU01B2E83.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcagggccctcccacatcggttatttctttgactcctggggccagggaaccctggtccaccgtctcctc

SEQ ID NO: 454765 - DNA, 538 bp, Homo sapiens
  misc_feature: HEFZJCU01D3RU0.52.81.H04.1.454.heavy.3.raw
cgcagtacgacacgaccggtgctcgatttagtagtgtagattcgcgggggctcggggagaggagccccagccgtgagattcccaggagtttccacttggtgatcagcactgaacacagaccaccaaccatggagtttgggcttagctgggttttccttgttgctattttaaaaggtgcccaatgtgaggtgcagctggtggagtctgggggaggcttggtgcagccagggcggtccctgagactctcctgttcagcttccggagtcacctttggtcattatgctatgaactgggtccgccaggctccagggaagggcctgtcttgggtaggtttcattagaggcgacgcttttggtgggacaacagaatacgccgcgtctgtgaaaggcagattcaccatctcaagagatgattccaaagcgtcgtctacttgcaaatgaacagcctgaaatccgaggacacagccgtgtattactgtactagagagtattggagttcggggaaaattactactccggtatggacgtcgtggggaccg

SEQ ID NO: 454766 - DNA, 483 bp, Homo sapiens; identical to SEQ ID NO: 444532
  misc_feature: HEFZJCU01CRWX6.47.59.F04.1.454.heavy.3.raw

SEQ ID NO: 454767 - DNA, 481 bp, Homo sapiens; identical to SEQ ID NO: 451860
  misc_feature: HEFZJCU01DO463.19.71.G05.1.454.heavy.3.raw

SEQ ID NO: 454768 - DNA, 501 bp, Homo sapiens; identical to SEQ ID NO: 452775
  misc_feature: HEFZJCU01DLPZA.3.20.B09.1.454.heavy.3.raw

SEQ ID NO: 454769 - DNA, 503 bp, Homo sapiens
  misc_feature: HEFZJCU01AI0A5.49.31.C09.1.454.heavy.3.raw
agtcgagagacacgaccggtgctcgatttagacgtctcatcaaggaaggaagggacctcaggggtccgggagatcatgagggtgtccctgggactctcctgtgcagcctctggattcactttcagcagctatggcatgaactgggtccgccaggctccagaaaaggggctggagtgggtctcaggtattagtggtagtggtggtatcacatcctacgtagactccgtgaagggccggttcaccatctccagagacaattccaagaacaaactttatttgcacatggaaagcctgagagccgaggacacggccatatattactgtgcgagacgtgggaactacttaggaggtgctttgatgtctggggccaagggacaatggtcaccgtctcttcagcctccaccaagggcccatcggtcttcccctggcaccctcctccaagagcacctctgggggcacagcggccctgggctgcctgtcaaggactacttcctctctcgact

SEQ ID NO: 454770 - DNA, 522 bp, Homo sapiens
  misc_feature: HEFZJCU01CM47J.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccgacgtacgtatact

SEQ ID NO: 454771 - DNA, 490 bp, Homo sapiens; identical to SEQ ID NO: 446494
  misc_feature: HEFZJCU01B3IJ9.11.13.B02.1.454.heavy.3.raw

SEQ ID NO: 454772 - DNA, 509 bp, Homo sapiens
  misc_feature: HEFZJCU01C9HJK.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggaccacggccacatattactgtgcgaaagatctcgggctggttccgcggtccgggt

SEQ ID NO: 454773 - DNA, 494 bp, Homo sapiens
  misc_feature: HEFZJCU01CYS8S.52.55.E11.1.454.heavy.3.raw
cgcagtacgacacgaccggtgctcgatttagcactcgcacgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttcccctggcaccctcctccaagagcacctctgggggcacagcggccctgggctgcctggtcaaggactacttcctatacgatcg

SEQ ID NO: 454774 - DNA, 497 bp, Homo sapiens
  misc_feature: HEFZJCU01EDO26.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctgggggtggctacgagtactggtacttcgatctctggggccgtggcaccctgctgactgtctcctcagcctccaccaagggcccatcggtcttcccctggcgccctgctccaggagcacctccgagagcacagcggccctggctgcctggtcaaggactacg

SEQ ID NO: 454775 - DNA, 491 bp, Homo sapiens; identical to SEQ ID NO: 447010
  misc_feature: HEFZJCU01EWMNI.4.7.A07.1.454.heavy.3.raw

SEQ ID NO: 454776 - DNA, 511 bp, Homo sapiens
  misc_feature: HEFZJCU01CHEB6.51.12.B01.1.454.heavy.3.raw
cgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttgacgacacggccgtctattactgtgcgacagaagcggcggacgagaggttcgcttacctggttcgtaggctctccccc

SEQ ID NO: 454777 - DNA, 523 bp, Homo sapiens
  misc_feature: HEFZJCU01DCRF9.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatcctccagagacaattccaagaacacgctgtttctcaaatgaacagcctgagagccgatgacacggccgtgtattactgtgcgagagagtggggcccacgaacgttactacgctatggacgtcgtggggccaaggggacccg

SEQ ID NO: 454778 - DNA, 492 bp, Homo sapiens
  misc_feature: HEFZJCU01BOVYM.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcgggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtct

SEQ ID NO: 454779 - DNA, 530 bp, Homo sapiens
  misc_feature: HEFZJCU01EIC6V.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacaccttcccttgacttctggggccatggaaccccggtccg

SEQ ID NO: 454780 - DNA, 522 bp, Homo sapiens
  misc_feature: HEFZJCU01A8MEH.52.58.F03.1.454.heavy.3.raw
cgcagtacgacacgaccggtgctcgatttagtctgatcgagaagggaaaggggagctctgggagacgagcccagcactggaagtcgccggtgtttccattcggtgatcatcactgaacacagaggactcaccatggaatttgggctgacttgggttttcctcgttgctcttttaagaggtgtccagtgtcaggtgcaactggtggagtctgggggaggcgtggtccagcctgggaggtccctgagactctcctgtgtcgcctctggattcaccttcagtatttatggcatttattgggtccgtcaggctccaggcaaggggctgtaatgggtggcctttattcatatgatggaaccaataaagcctacactgactccgtgaagggccgattcaccatctcccgagacaattccaagaacacactctatctgcaaatgaacagcctgagacatgaggacacggctgtttactcttgtgcgagaattgccctcgtttacgggggccctttgactaacgtcgggg

SEQ ID NO: 454781 - DNA, 324 bp, Homo sapiens; identical to SEQ ID NO: 444475
  misc_feature: HEFZJCU01CZ7AA.18.17.B06.1.454.heavy.3.raw

SEQ ID NO: 454782 - DNA, 497 bp, Homo sapiens
  misc_feature: HEFZJCU01DCZ5X.53.22.B11.1.454.heavy.3.raw
cgcgtatacacacgaccggtgctcgatttagacgacagctcagggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtgcagttatatcctatgatggaagcaaataagcactacgcagagtccgtgaagggccgattgaccatctccagagacaactcgaagaatacggttctctacaatgaacagcctgagagctgaggacacggctatgtttactggtgcgagaggaactcgattacagcagccctacg

SEQ ID NO: 454783 - DNA, 536 bp, Homo sapiens
  misc_feature: HEFZJCU01A1L3C.19.10.A10.1.454.heavy.3.raw
tactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgcctggtggagtctgggggaggcgtggtccagcccagggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaaatactggggacggggggaaagttggggcagggaaccctggtctccgtctcgtcacg

SEQ ID NO: 454784 - DNA, 509 bp, Homo sapiens
  misc_feature: HEFZJCU01DGIR5.48.44.D11.1.454.heavy.3.raw
agtatacatacacgaccggtgctcgatttagcgcagtacgaaggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttccccctggccgccctgctccaggagcacctccgagagcacagcggccctgggctgcctggtcaaggactacttcctatgtatact

SEQ ID NO: 454785 - DNA, 522 bp, Homo sapiens
  misc_feature: HEFZJCU01EMYAR.49.38.D05.1.454.heavy.3.raw
agtcgagagacacgaccggtgctcgatttagtatctgatagttgggtttggggaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactacgtggggccaggggaaccccggtcaccgtctcctctgcctccaccaac

SEQ ID NO: 454786 - DNA, 501 bp, Homo sapiens
  misc_feature: HEFZJCU01BXEKT.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttggatatctggggccaaggggc

SEQ ID NO: 454787 - DNA, 526 bp, Homo sapiens
  misc_feature: HEFZJCU01D1U9Y.49.81.H04.1.454.heavy.3.raw
agtcgagagacacgaccggtgctcgatttagtagtgtagattcgcgggggggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctattttattactgtgcgaacttaatcacggaggacaaggggtcgaacccccgtccactcggtaccggtacgg

SEQ ID NO: 454788 - DNA, 492 bp, Homo sapiens; identical to SEQ ID NO: 444695
  misc_feature: HEFZJCU01BM1CM.3.34.D01.1.454.heavy.3.raw

SEQ ID NO: 454789 - DNA, 496 bp, Homo sapiens
  misc_feature: HEFZJCU01DHKW4.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcggaattggtggcggtgactgctattgactactggggccaggggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 454790 - DNA, 467 bp, Homo sapiens; identical to SEQ ID NO: 448623
  misc_feature: HEFZJCU01B5KUI.48.59.F04.1.454.heavy.3.raw

SEQ ID NO: 454791 - DNA, 515 bp, Homo sapiens
  misc_feature: HEFZJCU01DTYSA.52.25.C03.1.454.heavy.3.raw
cgcagtacgacacgaccggtgctcgatttagtagtgtagatttgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaagggcttgagtggatggggtggaacaatcccaacagtggaggcaccggtcgcacagaatatgcgcggaagtttcagggcagggtcaccatgaccagcgacaggtccactaacacagcctacatggagctaagtagactgacatctgacgacacggccgtctattattgtgtgagagaggacccgatgacctcgaacatggacgttctggggccac

SEQ ID NO: 454792 - DNA, 522 bp, Homo sapiens; identical to SEQ ID NO: 449550
  misc_feature: HEFZJCU01BWRXD.12.40.D07.1.454.heavy.3.raw

SEQ ID NO: 454793 - DNA, 500 bp, Homo sapiens
  misc_feature: HEFZJCU01ERA9T.51.11.A11.1.454.heavy.3.raw
cgatcgtatacacgaccggtgctcgatttagctacgactgcagggctacgactgcagggtgtacacctgtggttctcggggctgccctttggctttggagatggttttctcgatgggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtcttctctggattcaccttcagggtctatgacatgcactgggtccgccaggctccaggcaaggggctggagtgggtggcagttatatcatatgatggaagtaataaatactatgcagactccgtgaagggccgattcaccgtctccagagacaattccaagaatacgctgtatctgcacata

SEQ ID NO: 454794 - DNA, 503 bp, Homo sapiens; identical to SEQ ID NO: 445995
  misc_feature: HEFZJCU01C2PZD.17.25.C03.1.454.heavy.3.raw

SEQ ID NO: 454795 - DNA, 501 bp, Homo sapiens; identical to SEQ ID NO: 446422
  misc_feature: HEFZJCU01ASG63.48.53.E09.1.454.heavy.3.raw

SEQ ID NO: 454796 - DNA, 518 bp, Homo sapiens
  misc_feature: HEFZJCU01AKVYV.16.67.G01.1.454.heavy.3.raw
tgtactactccacgaccggtgctcgatttagagtatacatattgggtttggggagctctgagagaggagcccagccctgggatttccaggtgttttcatttggggatcaggactgaacagagagaactcaccatggagttagggctgagcgtggcgttttcttaggtggctattttaaaaggtgtccagtgtgaggtgcagctgttggagtctgggggaggcttggtacagcctggggggtccctgagactctcctgtgcgacctctggattcacctttagcagctatgccatgagctgggtccgccaggctccagggaaggggctggagtgggtctcaactattagtggtagtggtggtaccacatacttcgctgactccgtgaagggccggttctccatctccagagacacttccaagaacacggtgtatctgcaagtgcacagcctgagagccgaggacacggccatatattactgtgcgaaagcaccggcagttagtcacccatactactttga

SEQ ID NO: 454797 - DNA, 466 bp, Homo sapiens
  misc_feature: HEFZJCU01DUADS.9.30.C08.1.454.heavy.3.raw
tgatacgtctcacgaccggtgctcgatttagtctgacgtcaaagggaaagggttgtagtaggtgactccatcaccggtactaattactactggagttggatccgccagccccccgggaagggcctggagtggattggatacggccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcagcctccaccaagggcccatcggtcttccccctggcgccctgctccaggagcacctccgagagcacagcggccctgggcgtgcctggtcaaggactacttccagacgtatca

SEQ ID NO: 454798 - DNA, 380 bp, Homo sapiens
  misc_feature: HEFZJCU01C2J78.9.53.E09.1.454.heavy.3.raw
tgatacgtctcacgaccggtgctcgatttagagagagtgtgttggggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaagggcccatcggtcttcccctggcgccctgctccaggagcacctccgagagcacagcggccctgggctgcctggtcaaggactacttccagacgtatca

SEQ ID NO: 454799 - DNA, 504 bp, Homo sapiens; identical to SEQ ID NO: 445648
  misc_feature: HEFZJCU01CAUFL.17.25.C03.1.454.heavy.3.raw

SEQ ID NO: 454800 - DNA, 392 bp, Homo sapiens; identical to SEQ ID NO: 444456
  misc_feature: HEFZJCU01CQCW0.7.60.F05.1.454.heavy.3.raw

SEQ ID NO: 454801 - DNA, 497 bp, Homo sapiens; identical to SEQ ID NO: 446430
  misc_feature: HEFZJCU01DK1LF.51.78.H01.1.454.heavy.3.raw

SEQ ID NO: 454802 - DNA, 496 bp, Homo sapiens
  misc_feature: HEFZJCU01CXTCQ.51.64.F09.1.454.heavy.3.raw
cgatcgtatacacgaccggtgctcgatttagcgcgtatacaaggggctgggagaggagcccagcactagaagtcggcggtgtttccattcggtgatcagcactgaacacagaggactcaccatggagtttgggctgagctgggttttcctcgtcgttcttataagaggtgtccagtctgaggcgcagctggtggagtctgggggaggagtggtccagcctgggaggtccttgagactctcctgtgcagcctctggattcaccttcagagtctatggcatgaactgggtccgccaggctccaggcaaggggctggagtgggtggcattcatttcagaggatggaattaagagatactatacagactccgtgaagggccgattcaccatctccagagacaattccaagaactcgctctatctgcaaatgagcagcctgagacctgaggacacggctgtctattactgtgcgaaacggaatgagtgggaactagggttt

SEQ ID NO: 454803 - DNA, 510 bp, Homo sapiens
  misc_feature: HEFZJCU01BKZWL.51.5.A05.1.454.heavy.3.raw
cgatcgtatacacgaccggtgctcgatttagatagatagacaggggagtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctcctgaggctgacgtctttaagtgtcgctgatacgggtgtctatttctgtgcgagactgcccggtcctgcacctcgtgtggccccaatttcggtttaccggcacacaaatcagggcaagtcctacgacggtcgtc

SEQ ID NO: 454804 - DNA, 372 bp, Homo sapiens; identical to SEQ ID NO: 444727
  misc_feature: HEFZJCU01DXT0G.3.42.D09.1.454.heavy.3.raw

SEQ ID NO: 454805 - DNA, 525 bp, Homo sapiens; identical to SEQ ID NO: 453584
  misc_feature: HEFZJCU01DQKR2.47.6.A06.1.454.heavy.3.raw

SEQ ID NO: 454806 - DNA, 520 bp, Homo sapiens
  misc_feature: HEFZJCU01C7F89.9.33.C11.1.454.heavy.3.raw
tgatacgtctcacgaccggtgctcgatttagagtgagctcgttgggtttgggctgagcgtggtttcgtcgttaggctctttaagaggtgtccagtgtcaagtgcaactggtggagtctgggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaaggcccatcggtctcccctggcgcctgctccagagcacctccg

SEQ ID NO: 454807 - DNA, 436 bp, Homo sapiens
  misc_feature: HEFZJCU01DWY7E.3.21.B10.1.454.heavy.3.raw
agacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagttttgacagctggggccagggaaccctggtcaccgtctcctcagcctccaccaagggcccatcggtcttcccctggcgccctgctccaggagcacctccgagagcacagcggccctgggctgcctggtcaaggactacttccgagtgcgtct

SEQ ID NO: 454808 - DNA, 396 bp, Homo sapiens; identical to SEQ ID NO: 444469
  misc_feature: HEFZJCU01BXAZA.47.46.E02.1.454.heavy.3.raw

SEQ ID NO: 454809 - DNA, 516 bp, Homo sapiens; identical to SEQ ID NO: 445176
  misc_feature: HEFZJCU01EKCEU.14.66.F11.1.454.heavy.3.raw

SEQ ID NO: 454810 - DNA, 504 bp, Homo sapiens
  misc_feature: HEFZJCU01CO4XG.49.38.D05.1.454.heavy.3.raw
agtcgagagacacgaccggtgctcgatttagtatctgatagttgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagcctggtcaccgtctcctcagcttccaccaacgggcccatcggtcttcccctcggccgccctgcctccacgg

SEQ ID NO: 454811 - DNA, 496 bp, Homo sapiens; identical to SEQ ID NO: 444697
  misc_feature: HEFZJCU01EG4KM.16.37.D04.1.454.heavy.3.raw

SEQ ID NO: 454812 - DNA, 495 bp, Homo sapiens
  misc_feature: HEFZJCU01C9W8V.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaaggcccatcggtcttcccctggcaccctcctccaagagcacctctgggggcacagcggccctgggctgcctggtcaaggactacttccgagtagtaca

SEQ ID NO: 454813 - DNA, 522 bp, Homo sapiens; identical to SEQ ID NO: 449664
  misc_feature: HEFZJCU01CRN03.9.63.F08.1.454.heavy.3.raw

SEQ ID NO: 454814 - DNA, 522 bp, Homo sapiens; identical to SEQ ID NO: 446788
  misc_feature: HEFZJCU01DIW03.12.40.D07.1.454.heavy.3.raw

SEQ ID NO: 454815 - DNA, 509 bp, Homo sapiens
  misc_feature: HEFZJCU01CB1Y9.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatggacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgcctggtcaaggactacttcctacgtcgtat

SEQ ID NO: 454816 - DNA, 509 bp, Homo sapiens
  misc_feature: HEFZJCU01DTOCC.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcgcagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttctggggccaggggacg

SEQ ID NO: 454817 - DNA, 496 bp, Homo sapiens; identical to SEQ ID NO: 445798
  misc_feature: HEFZJCU01EHYUN.12.55.E11.1.454.heavy.3.raw

SEQ ID NO: 454818 - DNA, 519 bp, Homo sapiens; identical to SEQ ID NO: 444867
  misc_feature: HEFZJCU01DTWAG.9.34.D01.1.454.heavy.3.raw

SEQ ID NO: 454819 - DNA, 387 bp, Homo sapiens; identical to SEQ ID NO: 445229
  misc_feature: HEFZJCU01A3NRM.11.20.B09.1.454.heavy.3.raw

SEQ ID NO: 454820 - DNA, 524 bp, Homo sapiens
  misc_feature: HEFZJCU01BYZS5.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacacgcggccctgggctgcctgtcaaggactacttcc

SEQ ID NO: 454821 - DNA, 532 bp, Homo sapiens
  misc_feature: HEFZJCU01DTPTS.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgtactactgggggttcggtaccccgtcggggccgagggaaccctggtcaccgtctcctcagcctccaccg

SEQ ID NO: 454822 - DNA, 515 bp, Homo sapiens
  misc_feature: HEFZJCU01EXV5E.19.67.G01.1.454.heavy.3.raw
  modified_base (487)..(487): a, c, t, g, unknown or other
tactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggttatttttataggtgggacgacattctacggagactccatggagggccgattcaccatctccagagacttttctcagaacacactgtctcttcaaatgaacagcctgagggccgagggacacggccgtctattattgtgtgagtagttttanggcgatggctgggtggacagatcacgtc

SEQ ID NO: 454823 - DNA, 530 bp, Homo sapiens
  misc_feature: HEFZJCU01BM7ZU.48.27.C05.1.454.heavy.3.raw
  modified_base (501)..(501): a, c, t, g, unknown or other
agtatacatacacgaccggtgctcgatttagacgcgatcgaaggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttccccctggcgccctgctccaggagcacctccgagagcacagcggccctgggctgcctggtcgagtactacctctatntatctgtgcggcggtcgtcgacgacggcg

SEQ ID NO: 454824 - DNA, 507 bp, Homo sapiens; identical to SEQ ID NO: 446637
  misc_feature: HEFZJCU01C7ZOB.16.34.D01.1.454.heavy.3.raw

SEQ ID NO: 454825 - DNA, 517 bp, Homo sapiens
  misc_feature: HEFZJCU01BVSLQ.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggctactcctagagacacg

SEQ ID NO: 454826 - DNA, 495 bp, Homo sapiens
  misc_feature: HEFZJCU01DZNGL.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtgctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaggactacc

SEQ ID NO: 454827 - DNA, 518 bp, Homo sapiens
  misc_feature: HEFZJCU01EPJSU.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtggggccggggaaccctggtcaccgtctcttcagcctccaccaacgggcccatccggtcttcccctggcaccctcctccaagacgcacctctgggggcac

SEQ ID NO: 454828 - DNA, 503 bp, Homo sapiens
  misc_feature: HEFZJCU01BIMIT.48.86.H09.1.454.heavy.3.raw
agtatacatacacgaccggtgctcgatttagtgctatagacttgggtttgggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggccaagggacaatggtcaccgtctcttcagcctccaccaa

SEQ ID NO: 454829 - DNA, 512 bp, Homo sapiens
  misc_feature: HEFZJCU01EEEWB.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaaccggcagttagtcacccatactactttgactactggggaccg

SEQ ID NO: 454830 - DNA, 507 bp, Homo sapiens
  misc_feature: HEFZJCU01CB7OP.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctccggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaa

SEQ ID NO: 454831 - DNA, 489 bp, Homo sapiens; identical to SEQ ID NO: 444791
  misc_feature: HEFZJCU01A7Q64.47.85.H08.1.454.heavy.3.raw

SEQ ID NO: 454832 - DNA, 506 bp, Homo sapiens; identical to SEQ ID NO: 444696
  misc_feature: HEFZJCU01DAAR4.16.34.D01.1.454.heavy.3.raw

SEQ ID NO: 454833 - DNA, 502 bp, Homo sapiens
  misc_feature: HEFZJCU01C06N4.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggaatggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgattatctggggccaaggggac

SEQ ID NO: 454834 - DNA, 518 bp, Homo sapiens; identical to SEQ ID NO: 450435
  misc_feature: HEFZJCU01B5A1C.13.76.G10.1.454.heavy.3.raw

SEQ ID NO: 454835 - DNA, 491 bp, Homo sapiens; identical to SEQ ID NO: 444592
  misc_feature: HEFZJCU01DCBIE.11.26.C04.1.454.heavy.3.raw

SEQ ID NO: 454836 - DNA, 506 bp, Homo sapiens; identical to SEQ ID NO: 446520
  misc_feature: HEFZJCU01D05HC.10.38.D05.1.454.heavy.3.raw

SEQ ID NO: 454837 - DNA, 378 bp, Homo sapiens
  misc_feature: HEFZJCU01CEL9Q.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctggctgcctggtcaaggactacttcctacgtgagct

SEQ ID NO: 454838 - DNA, 502 bp, Homo sapiens
  misc_feature: HEFZJCU01D2JR1.26.80.H03.1.454.heavy.3.raw
agactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatatccactgggtgcggcaggcccctggacaagggcttgagtggatgggacacatcagccctaacactggtgacacaaactatgcacagagatttcagggcagggtcaccatgaccacggacacgtccataagcacagtttacatggaggtaaataggctgagatctgacgacacggccgtatattactgtgcgttattaacggacgattacgatgtttgattggtttttacg

SEQ ID NO: 454839 - DNA, 490 bp, Homo sapiens
  misc_feature: HEFZJCU01CH99L.4.57.F02.1.454.heavy.3.raw
agcactgtagcacgaccggtgctcgatttagctcgatatagttgggtttgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaaggcccatcggtcttcccctggcgccctgctccaggagcacctctgggggcacagcggccctgggctgcctggtcaaggactacttccctacagtgct

SEQ ID NO: 454840 - DNA, 489 bp, Homo sapiens; identical to SEQ ID NO: 444591
  misc_feature: HEFZJCU01B7UN2.18.70.G04.1.454.heavy.3.raw

SEQ ID NO: 454841 - DNA, 492 bp, Homo sapiens
  misc_feature: HEFZJCU01ESPCU.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagacctccctgaggggccgattcaccatctccagagacaattcccagaacacggtctatctgcacctgaccagcctgagaactgacgacacgtctctctactactgtgcgagagagttgacgagt

SEQ ID NO: 454842 - DNA, 509 bp, Homo sapiens
  misc_feature: HEFZJCU01EIDBF.2.33.C11.1.454.heavy.3.raw
acgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcg

SEQ ID NO: 454843 - DNA, 511 bp, Homo sapiens
  misc_feature: HEFZJCU01CBZ5A.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaaccctc

SEQ ID NO: 454844 - DNA, 529 bp, Homo sapiens
  misc_feature: HEFZJCU01DWSD6.17.34.D01.1.454.heavy.3.raw
cgtagactagcacgaccggtgctcgatttagatcgtctgtgttgggtttggggatcacaaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttcgacttctgggccatggaaccccggtcc

SEQ ID NO: 454845 - DNA, 506 bp, Homo sapiens; identical to SEQ ID NO: 444713
  misc_feature: HEFZJCU01AS3BJ.5.41.D08.1.454.heavy.3.raw

SEQ ID NO: 454846 - DNA, 539 bp, Homo sapiens
  misc_feature: HEFZJCU01C4UD9.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtgctggatcggggagtttggttcctggggccagggaaccctggtcc

SEQ ID NO: 454847 - DNA, 510 bp, Homo sapiens
  misc_feature: HEFZJCU01BARJI.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgattcaccatctccagagacaacgccaagaattcactgtatttgcaaatgaacagcctgagaggcgaggacacggccgtgtatattgtgcgcgagatgatagtagactctacagtagcaggtggta

SEQ ID NO: 454848 - DNA, 396 bp, Homo sapiens; identical to SEQ ID NO: 444469
  misc_feature: HEFZJCU01B1Y36.47.46.E02.1.454.heavy.3.raw

SEQ ID NO: 454849 - DNA, 521 bp, Homo sapiens
  misc_feature: HEFZJCU01DK286.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgactttgggccagggaaccctggtcaccgtctcctcagcctccaccaaggcccatcggtcttcccctgcaccctcctccaagagcacctctggggcacagcggcctggctg

SEQ ID NO: 454850 - DNA, 483 bp, Homo sapiens; identical to SEQ ID NO: 450288
  misc_feature: HEFZJCU01CB4V8.19.71.G05.1.454.heavy.3.raw

SEQ ID NO: 454851 - DNA, 510 bp, Homo sapiens
  misc_feature: HEFZJCU01BQIS8.9.12.B01.1.454.heavy.3.raw
tgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactgggtccgccaggctccagggaaggggctggagtggggtctcagttatttatagcggtggtaacacatactacgcagactccgtgaagggcagattcaccatctccagagacaattccaggaacacgctgtatcttcaaatgaacagcctgagagtcgaggacacggctgtatattactgtgcgagagatgtgtacgcttttgatatctggggaccg

SEQ ID NO: 454852 - DNA, 508 bp, Homo sapiens; identical to SEQ ID NO: 445594
  misc_feature: HEFZJCU01CZXIQ.17.25.C03.1.454.heavy.3.raw

SEQ ID NO: 454853 - DNA, 504 bp, Homo sapiens
  misc_feature: HEFZJCU01DSUFU.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccagagcacctccgagagcacagcggccctgggctgcctggtcaaggactacttcccactacta

SEQ ID NO: 454854 - DNA, 500 bp, Homo sapiens; identical to SEQ ID NO: 445720
  misc_feature: HEFZJCU01ECXOU.3.20.B09.1.454.heavy.3.raw

SEQ ID NO: 454855 - DNA, 533 bp, Homo sapiens
  misc_feature: HEFZJCU01C6J33.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctagagagccgaggacacggccatgtattactgtgtggggcatttacttgacccctggggccggggaacccgtggtcaccgtctccccaccctccaacccg

SEQ ID NO: 454856 - DNA, 329 bp, Homo sapiens
  misc_feature: HEFZJCU01CXQG2.10.42.D09.1.454.heavy.3.raw
catagtagtgcacgaccggtgctcgatttagacacatacgcagggaaagggccggttcaccatctcgagagacaacaccaagaacacgctgaatctgcaaatgaacagcctgagagccgaggacacggctgtatattactgtgtgagggatgtcccccagaaagggctggttacatgtttgactcctggggccagggaatcctggtcaccgtctcctcagcctccaccaagggcccatcggtcttccccctggcgccctgctccaggagcacctccgagagcacagcggccctgggctgcctggtcaaggactacttcccactactatg

SEQ ID NO: 454857 - DNA, 531 bp, Homo sapiens
  misc_feature: HEFZJCU01CKQGO.40.27.C05.1.454.heavy.3.raw
tctagcgactcacgaccggtgctcgatttagacgcgatcgaagggtttggggatgctttctgagagtcatggatctcatgtgcaagaaaatgaagcacctgtggttcttcctcctgctggtggcggctcccagatgggtcctgtcccagttgcagttgcaggagtcgggcccaggactggtgaagacttcggagaccctgtccctcacgtgcactgtctctggtggctccatccgcaatcgtcgattctattggggctgggtccgccggcccccagggaaggggctggagtggattgcgagcatatattatgatgagagcgccctctacaaccccccctctacaaccctccctcaagagtcggtcaccatatctatagacacgtccaacagtcaattctccctggacttgacctctgtgaccgccgcagacacggctgtatattcctgtgcgacccacgggacggggatggccccaaatcctgcctacttttgacccacgtgggggccaggggtaaccttgggtcctaccc

SEQ ID NO: 454858 - DNA, 482 bp, Homo sapiens; identical to SEQ ID NO: 444503
  misc_feature: HEFZJCU01DD250.7.10.A10.1.454.heavy.3.raw

SEQ ID NO: 454859 - DNA, 521 bp, Homo sapiens; identical to SEQ ID NO: 446777
  misc_feature: HEFZJCU01EKW99.49.59.F04.1.454.heavy.3.raw

SEQ ID NO: 454860 - DNA, 519 bp, Homo sapiens
  misc_feature: HEFZJCU01BBL4Y.48.38.D05.1.454.heavy.3.raw
agtatacatacacgaccggtgctcgatttagtatctgatagttgggtttggggagtgactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatgggtgacaagcgttacagtgcatctctgaagaccagactctccatcaccaaggacacctccaagaacgaggttgtcctttccttggccaacatgcaccctgtggacacggccacttatttttgtacacacaccatcttgacgactggggatgcttttcatttctgggccaggggaccgtggtcgccgtgtctacagcctccaccaagggcccatcggtctt

SEQ ID NO: 454861 - DNA, 406 bp, Homo sapiens
  misc_feature: HEFZJCU01CE50C.17.37.D04.1.454.heavy.3.raw
cgtagactagcacgaccggtgctcgatttagtagcatactgttgggtttgggctcaactctcttgtccaccctggtgtgggtctcacgtattgatactgatggcattaccacatcctacgcggactccgtgcagggccgattcaccatctccagagacaacgccaagaacacgctgtatctgcaaatgaacagtctgagagccgaggacacggctgtgtactactgtgcaagagtttcccccggcagctcgcccggtaacttctggggccagggaacccaggtcaccgtctcctcagcctccaccaagggcccatcggtcttccccctggcaccctcctccaagagcacctctgggggcacagcggccctgggctgcctggtcaaggactacttccctagtctacg

SEQ ID NO: 454862 - DNA, 533 bp, Homo sapiens
  misc_feature: HEFZJCU01CFF6I.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattggacagtctgagacccgaggacacggctgtgtattactgttgcaaggcagttcgtggaaacagttatgggttggggggagtggggttttttttcgttacttacgggt

SEQ ID NO: 454863 - DNA, 523 bp, Homo sapiens
  misc_feature: HEFZJCU01EOF1W.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaaccctggtcaccgtctccccaccctcccaccaagggcccatcggtcttccccctggcaccctcctccaagagcacctctgggggcacagcggcctggctgcctggtcaaggactacttccatactcta

SEQ ID NO: 454864 - DNA, 506 bp, Homo sapiens
  misc_feature: HEFZJCU01DCG4L.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggcc

SEQ ID NO: 454865 - DNA, 491 bp, Homo sapiens; identical to SEQ ID NO: 445531
  misc_feature: HEFZJCU01EZG4N.11.38.D05.1.454.heavy.3.raw

SEQ ID NO: 454866 - DNA, 484 bp, Homo sapiens
  misc_feature: HEFZJCU01EF9NT.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggccatcggtctcccctggcgcctgctccaggagcacctccgagagcacagcggccctgggctgcctggtcaaggactacttcctacgtgagct

SEQ ID NO: 454867 - DNA, 535 bp, Homo sapiens
  misc_feature: HEFZJCU01EA2EW.19.48.E04.1.454.heavy.3.raw
tactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgccaggctccggggaaggggccggagtgggtggccaacataatgcaagatggaactgagaaaactatggggactctgtgaagggccgattcaccatctccagagacaaccgtaagaacttactgtttctgcaaatgaacagcctgagagccgaggacacggctgtgtattattgtgcgaagggcaggtggctggggacagtggacgtcgtggggccaaggggaccacggtcaccgt

SEQ ID NO: 454868 - DNA, 505 bp, Homo sapiens
  misc_feature: HEFZJCU01EGGHR.53.33.C11.1.454.heavy.3.raw
cgcgtatacacacgaccggtgctcgatttagagtgagctcgttgggtttgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaagggccatcggtcttcccctggcgccctgctccaggagcacctctgggggcacagcggccctgggctgcctggtcaaggactacttcctcgtact

SEQ ID NO: 454869 - DNA, 512 bp, Homo sapiens
  misc_feature: HEFZJCU01A157O.53.72.G06.1.454.heavy.3.raw
cgcgtatacacacgaccggtgctcgatttagctacgactgcaagggaaaggggtcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcaccatctcgagagacaattccaggaacacgctgtatctgcaaatgaacggcctgagagctgaggacacggctgtgtattactgtgcgaaacggtttgagtgggaattaggggctggagtacggtatggacgtcgtggggccaaggggaccacggtcaccgtctcc

SEQ ID NO: 454870 - DNA, 517 bp, Homo sapiens; identical to SEQ ID NO: 454053
  misc_feature: HEFZJCU01DT4OI.47.78.H01.1.454.heavy.3.raw

SEQ ID NO: 454871 - DNA, 499 bp, Homo sapiens
  misc_feature: HEFZJCU01DXEL1.22.86.H09.1.454.heavy.3.raw
acatacgcgtcacgaccggtgctcgatttagtgctatagacttgggtttgggctgagcgtggtttcgtcgtaggctctttaagaggtgtccagtgtcaggtgcagctggtggagtctggggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccctggcgcctgctc

SEQ ID NO: 454872 - DNA, 545 bp, Homo sapiens
  misc_feature: HEFZJCU01DSG4W.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggcgtggagtcggggtagtttggttccgtggggccacggggaaccctgggt

SEQ ID NO: 454873 - DNA, 484 bp, Homo sapiens
  misc_feature: HEFZJCU01DQMAN.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttcccctggcgccctgctccaggagcacctcccgagagcacagcggccctggggctgcctggtcaaggactacttcctacgtgagct

SEQ ID NO: 454874 - DNA, 498 bp, Homo sapiens
  misc_feature: HEFZJCU01B7KGC.13.15.B04.1.454.heavy.3.raw
tcacgtactacacgaccggtgctcgatttagacagtatatatccgcgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcactgggtccgccaagctccagggaagggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagagtacacattaaattactatgatagtagtgg

SEQ ID NO: 454875 - DNA, 496 bp, Homo sapiens; identical to SEQ ID NO: 446592
  misc_feature: HEFZJCU01CVQ7Q.4.75.G09.1.454.heavy.3.raw

SEQ ID NO: 454876 - DNA, 519 bp, Homo sapiens; identical to SEQ ID NO: 453755
  misc_feature: HEFZJCU01AKAWA.9.70.G04.1.454.heavy.3.raw

SEQ ID NO: 454877 - DNA, 488 bp, Homo sapiens
  misc_feature: HEFZJCU01C9EB9.13.79.H02.1.454.heavy.3.raw
tcacgtactacacgaccggtgctcgatttagtgtcacacgaagggaaagggggtctcagagaggagccttagccctggactccaaggcctttccacttggtgatcagcactgagcacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaaggcgattcaccatctccagagacaattccaagaacacgcagtatctgcaaatgaacagcctgagagctgaggacacggctgtgtattactgtgggagagatggagtcg

SEQ ID NO: 454878 - DNA, 510 bp, Homo sapiens; identical to SEQ ID NO: 445542
  misc_feature: HEFZJCU01BQ2GQ.16.21.B10.1.454.heavy.3.raw

SEQ ID NO: 454879 - DNA, 524 bp, Homo sapiens
  misc_feature: HEFZJCU01BC7PS.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaagggaggggggaaccgagcgggagttccaagtactcctttgacgtctc

SEQ ID NO: 454880 - DNA, 519 bp, Homo sapiens
  misc_feature: HEFZJCU01DDV1L.13.76.G10.1.454.heavy.3.raw
tcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggccacgaacgttactacgctatggacgtctggggccaagggaccg

SEQ ID NO: 454881 - DNA, 499 bp, Homo sapiens
  misc_feature: HEFZJCU01ERWS8.3.81.H04.1.454.heavy.3.raw
agacgcactccacgaccggtgctcgatttagtagtgtagattcgcgggctggtggagtctgggggaggcttggtccagcctgggggtccctgagactctcctgtgcagcctctggattcagctttagtaccaattggatgaactgggtccgccaggctccagggaagggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatggggggccagggaaccctggtcaccgtctcctcagcctccaccaagggcccatcggtcttcccctggcgccctgctccaggagcacctccgagagcacagcggccgtgggctgcctggtcaaggactacttccga

SEQ ID NO: 454882 - DNA, 526 bp, Homo sapiens; identical to SEQ ID NO: 446878
  misc_feature: HEFZJCU01BFNYF.18.33.C11.1.454.heavy.3.raw

SEQ ID NO: 454883 - DNA, 489 bp, Homo sapiens
  misc_feature: HEFZJCU01B5JL9.10.71.G05.1.454.heavy.3.raw
catagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggcatca

SEQ ID NO: 454884 - DNA, 502 bp, Homo sapiens
  misc_feature: HEFZJCU01E0YQ0.48.23.C01.1.454.heavy.3.raw
agtatacatacacgaccggtgctcgatttagtacacgtgattagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgccttgatatgtgggccgaaggacaagtggtaccg

SEQ ID NO: 454885 - DNA, 507 bp, Homo sapiens
  misc_feature: HEFZJCU01BG15I.49.8.A08.1.454.heavy.3.raw
agtcgagagacacgaccggtgctcgatttagcatactctacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttatactgtgcgaacttaattacggaggacaacggtaacccctcgcacggtac

SEQ ID NO: 454886 - DNA, 510 bp, Homo sapiens
  misc_feature: HEFZJCU01ESQC4.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggcgattcaccatctccagagacaattccaggaacacaatgtatttggagctgaacagcctaagtcctgaggacacgggcgtatactactgtacgaaggagggggaaccagcggagtccaagtactccttgtacg

SEQ ID NO: 454887 - DNA, 496 bp, Homo sapiens
  misc_feature: HEFZJCU01EGVDQ.14.55.E11.1.454.heavy.3.raw
cgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatgggagggggtggtggatcc

SEQ ID NO: 454888 - DNA, 523 bp, Homo sapiens
  misc_feature: HEFZJCU01EKGJO.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagttacggttttgattagtttggggccaagggacaagggtcaccgtctccgcagcctccaccg

SEQ ID NO: 454889 - DNA, 532 bp, Homo sapiens
  misc_feature: HEFZJCU01DYDYF.14.40.D07.1.454.heavy.3.raw
cgtctagtaccacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccagggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaagacaaaacgtccgaagtcgttatcactttgactcctgggccagggaaccctggtcagcgtctcttcagcctccaccaaggcccatcggtcttcccctggccaccctcctccaagacgcacctctgggggcacagcggccctgggc

SEQ ID NO: 454890 - DNA, 527 bp, Homo sapiens
  misc_feature: HEFZJCU01EOEGO.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtggggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttataccttgacacttggggccagggaaccctggtcaccgtctcctcagcctccaccaagggcccatcggtcttcccctggcgccctgctccaggagcacctccgagagcacagcggccctgggctgcctggtcaaggactacttccacg

SEQ ID NO: 454891 - DNA, 500 bp, Homo sapiens
  misc_feature: HEFZJCU01EV5LS.10.12.B01.1.454.heavy.3.raw
catagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaagggactggaatggatgacagttatttcacacgatgcaaccaaaacatactacgcggagttcgtgaggggccgctgcatcgtctccagagacaattcgaagaacactctgtacctgcaaatgaacagtctgagagccgaggacacggccgtctacttttgtgcgactagaagtgggagctatagggg

SEQ ID NO: 454892 - DNA, 510 bp, Homo sapiens
  misc_feature: HEFZJCU01BPU4Y.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactgggccagggactctggtcaccgtctccgcagcctccaccaaggccc

SEQ ID NO: 454893 - DNA, 504 bp, Homo sapiens
  misc_feature: HEFZJCU01DC4BK.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagctgagatctgacgacacggccgtatattctgcgcgagagacgtaaagtgacgtggtattccggggggacacatgactaccg

SEQ ID NO: 454894 - DNA, 491 bp, Homo sapiens; identical to SEQ ID NO: 447981
  misc_feature: HEFZJCU01BCKVY.47.85.H08.1.454.heavy.3.raw

SEQ ID NO: 454895 - DNA, 507 bp, Homo sapiens
  misc_feature: HEFZJCU01CADDK.47.23.C01.1.454.heavy.3.raw
agctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggcccccggacagagacctgagtggatgggatggatcagcattggcaatggtaacataaaacactcacagaagttccagggcagggtcaccattaccagagacatctccgcgaccacagcctacatggaactgagcagcctgacttctgaagacacggctatttactactgtgcgagagagggggtttgactggaactccttctacatggacgtctggggcaaagggaccg

SEQ ID NO: 454896 - DNA, 547 bp, Homo sapiens
  misc_feature: HEFZJCU01BZRT4.48.3.A03.1.454.heavy.3.raw
agtatacatacacgaccggtgctcgatttagagagcgtcacagggggagagaggagcccagccctgggattttcaggtgttttcacttggtgatcaggactgaacagagagaactcaccatggagtttgggctgagctggctttttcttctggccattttaaaaggtgtccagtgtgaggagcagttgtcggaatctgggggagacctggtacagccgggggggtccctgacactctcctgtgtggcctctggattcatttttagcaaccacgccattacctgggtccgccagagtccagggaagggactggacggagtcgcgggtataagtggttttagtggaagtagattatacgcagagtccgtaaggggccggttcaccatctccagagacaattccaagaacacggcatatctacaatgaacaacctgggcgccgaagacacggccgtctattactgtgcgagatcctctactagtgccgcgaggtactttgaactctggggtcagggaaccctggtcaccgtctcctcagcctccaccaac

SEQ ID NO: 454897 - DNA, 530 bp, Homo sapiens
  misc_feature: HEFZJCU01AXO0W.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctggggcccgggaaccctggtcaccgtctcctcagcctccaccaagggcccatcggtcttcccctggccaccctcctcc

SEQ ID NO: 454898 - DNA, 400 bp, Homo sapiens; identical to SEQ ID NO: 445493
  misc_feature: HEFZJCU01C9IEV.13.4.A04.1.454.heavy.3.raw

SEQ ID NO: 454899 - DNA, 540 bp, Homo sapiens
  misc_feature: HEFZJCU01DKQF1.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagcgtggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctagagaaccgaggacacagccgtgtattactgtaccacatcccctgaaagcgtcaactactacctactacggtatggacctcgtggggaccg

SEQ ID NO: 454900 - DNA, 384 bp, Homo sapiens; identical to SEQ ID NO: 444454
  misc_feature: HEFZJCU01BQQQR.11.61.F06.1.454.heavy.3.raw

SEQ ID NO: 454901 - DNA, 499 bp, Homo sapiens; identical to SEQ ID NO: 452982
  misc_feature: HEFZJCU01CJR3V.11.71.G05.1.454.heavy.3.raw

SEQ ID NO: 454902 - DNA, 398 bp, Homo sapiens
  misc_feature: HEFZJCU01EK1V6.10.42.D09.1.454.heavy.3.raw
catagtagtgcacgaccggtgctcgatttagacacatacgcaggggaaggggctggagtgggtctcgactattaatggtcttgctgataatacacactacgcagacttcgtgaagggccggttcaccatctcgagagacaactaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaagggcccatcggtcttccccctggcgccctgctccaggtagcacctccgagagcacagcggccctgggctgcctggtcaaggactacttcccactactatg

SEQ ID NO: 454903 - DNA, 517 bp, Homo sapiens
  misc_feature: HEFZJCU01B5T9W.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacatggccatttatttctgtgcgaaggaggcatatgggaagtacgattttcgatccctccgcagtcgacactttgattactgggccggggaaccctggtcgccgtctcctcagcctccaccaagggcccatcggtcttccccctggcaccctcctccaagagcacctctgggggcacagcggcctgggctgcctggtcaaggactacttccagacgtatca

SEQ ID NO: 454904 - DNA, 468 bp, Homo sapiens
  misc_feature: HEFZJCU01BJJAE.48.59.F04.1.454.heavy.3.raw
agtatacatacacgaccggtgctcgatttagtacacacacttagggattgggtagggattggggcagggtgtacacctgtggttctcggggctgccctttggctttggagatggttttctcgatgggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaagggactacttcctatgtatact

SEQ ID NO: 454905 - DNA, 506 bp, Homo sapiens
  misc_feature: HEFZJCU01A18K1.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactgggccagggcaccctggtcaccgtctcctcagcttccaccaagggcccatcggtcttcccctggcgcctgctccaggagcacctctggggcacagcggccctgggctgcctggtcaggactacttccata

SEQ ID NO: 454906 - DNA, 511 bp, Homo sapiens
  misc_feature: HEFZJCU01EDIJA.21.35.D02.1.454.heavy.3.raw
tcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctgaaagaagaaggacacggctgtatataaactgtgcgcgaggaccttattattaatggttcaggggtaccattgactacgtggggccagggaaccctggtcaccgtctcctcagcctccaccg

SEQ ID NO: 454907 - DNA, 494 bp, Homo sapiens; identical to SEQ ID NO: 451550
  misc_feature: HEFZJCU01AYV83.4.21.B10.1.454.heavy.3.raw

SEQ ID NO: 454908 - DNA, 514 bp, Homo sapiens
  misc_feature: HEFZJCU01CQI5R.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctgggggccaaggggaccacggtcaccgtctcctcacgcctccaccgaagggcccattcc

SEQ ID NO: 454909 - DNA, 386 bp, Homo sapiens; identical to SEQ ID NO: 446054
  misc_feature: HEFZJCU01DINF4.18.60.F05.1.454.heavy.3.raw

SEQ ID NO: 454910 - DNA, 509 bp, Homo sapiens
  misc_feature: HEFZJCU01C0FWA.48.41.D08.1.454.heavy.3.raw
agtatacatacacgaccggtgctcgatttagtcacgcgagaaagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaagggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagccgcagtggcttttgtatgcctttgatatgtgggtccgagggacgaatggtcaccgtcttc

SEQ ID NO: 454911 - DNA, 437 bp, Homo sapiens; identical to SEQ ID NO: 447018
  misc_feature: HEFZJCU01DD555.40.27.C05.1.454.heavy.3.raw

SEQ ID NO: 454912 - DNA, 504 bp, Homo sapiens
  misc_feature: HEFZJCU01DTSXG.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgactttctc

SEQ ID NO: 454913 - DNA, 490 bp, Homo sapiens
  misc_feature: HEFZJCU01C8VXY.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatccta

SEQ ID NO: 454914 - DNA, 502 bp, Homo sapiens
  misc_feature: HEFZJCU01AOTI7.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaagacacggctgtgtattactgttcgagacgggctagtctgggatctagttatagtgactcgtcgttctggggccg

SEQ ID NO: 454915 - DNA, 512 bp, Homo sapiens
  misc_feature: HEFZJCU01ERJ71.14.71.G05.1.454.heavy.3.raw
  modified_base (135)..(135): a, c, t, g, unknown or other
  modified_base (437)..(437): a, c, t, g, unknown or other
cgtctagtaccacgaccggtgctcgatttagtgtcgtcgcaagagagaggagcccagccctgggattttcaggtgttttcattcggtgatcaggactgaacagagagaactcaccatggagtttgggctgagcgngtcgtttctaggtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtggaagggccggttcacttgtttccagagacaattccaagaacacactgtatctgcagatgaccagcctgaagngccgaggacacggccgtatattactgtgcgaaacgccaaagtattttggagttggttattaatacctttgacttc

SEQ ID NO: 454916 - DNA, 493 bp, Homo sapiens
  misc_feature: HEFZJCU01DQBEQ.52.53.E09.1.454.heavy.3.raw
cgcagtacgacacgaccggtgctcgatttagagagagtgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcggagcagccccgtaacttctggggccagggaacccgggtcaccgtctcctcagcctccaccaagggcccatcggtcttcccctggcaccctcctccaagagcacctctgggggcacagcggccctgggctgcctggtcaaggactacttcctatacgatcg

SEQ ID NO: 454917 - DNA, 523 bp, Homo sapiens
  misc_feature: HEFZJCU01DE7H6.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacggaacgttactacgctatggacgtctgggggccaagggacccg

SEQ ID NO: 454918 - DNA, 489 bp, Homo sapiens; identical to SEQ ID NO: 444791
  misc_feature: HEFZJCU01ELNRT.47.85.H08.1.454.heavy.3.raw

SEQ ID NO: 454919 - DNA, 513 bp, Homo sapiens
  misc_feature: HEFZJCU01EL7P0.53.70.G04.1.454.heavy.3.raw
cgcgtatacacacgaccggtgctcgatttagtgtagtgtgaagggaaagggtggagtctgggggagacttggtacagcctggcaggtccctgagactctcctgtgcagcctctggattcacgtttgatgattctgtcatgcactgggtccggcaaactccagggaagggcctggagtggctctcaggcattacttggaatagtggcagtacaggttatgcggactctgtgaagggccgattcaccatctccagagacaacagcaaggagctcctttatttacaaatggacagcctgagagttgaggacacggccgtatattactgtgtgaaagacagcggcccacctcgcagttggtattactattacgggatggacatctggggccgagggaccacggtcaccgtctcctcagcctccaccaacgggcccatcggtcttcccctggcgccctgctccaggagcacctccgagaacacagcgcctgggctgcctggtcaaggctacttctcgt

SEQ ID NO: 454920 - DNA, 521 bp, Homo sapiens
  misc_feature: HEFZJCU01BX28D.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaaggcccatcggtcttcccctggcg

SEQ ID NO: 454921 - DNA, 508 bp, Homo sapiens
  misc_feature: HEFZJCU01C14RY.10.71.G05.1.454.heavy.3.raw
catagtagtgcacgaccggtgctcgatttagtgtcgtcgcaagagagagggggcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggcatcacctggtattgtgacttccggggccagggaaccgtggtcaccgtctccg

SEQ ID NO: 454922 - DNA, 548 bp, Homo sapiens; identical to SEQ ID NO: 453206
  misc_feature: HEFZJCU01DRR3F.48.3.A03.1.454.heavy.3.raw

SEQ ID NO: 454923 - DNA, 536 bp, Homo sapiens
  misc_feature: HEFZJCU01CTC4R.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggcccctggggcccgggaaccctggtcaccgtctcctcagcctccaccaagggcccatcggtcttcccctggcaccctcctccaagacg

SEQ ID NO: 454924 - DNA, 524 bp, Homo sapiens
  misc_feature: HEFZJCU01DNDLS.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggaccaggggacccgtggtcatcgtctccccagcctccaccaagggcccatcggtcttccccctggccg

SEQ ID NO: 454925 - DNA, 490 bp, Homo sapiens
  misc_feature: HEFZJCU01BXNJT.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaaggcccatcggtcttcccctggcgccctgctccaggagcacctccgagagcacagcggccctgggctgcctggtcaaggactacttccgtatctctcg

SEQ ID NO: 454926 - DNA, 517 bp, Homo sapiens
  misc_feature: HEFZJCU01DYSGG.7.71.G05.1.454.heavy.3.raw
cgtgtctctacacgaccggtgctcgatttagtgtcgtcgcaagagagaggggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaggagggggaccagcggagttccaagtactcctttgacgtctc

SEQ ID NO: 454927 - DNA, 503 bp, Homo sapiens; identical to SEQ ID NO: 445995
  misc_feature: HEFZJCU01E2H3H.17.25.C03.1.454.heavy.3.raw

SEQ ID NO: 454928 - DNA, 512 bp, Homo sapiens
  misc_feature: HEFZJCU01ELRMQ.3.55.E11.1.454.heavy.3.raw
  modified_base (503)..(503): a, c, t, g, unknown or other
agacgcactccacgaccggtgctcgatttagcactcgcacgttgggtttgggctgagcgtggtttcgtcgttagctctttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgatggaagaaaaaatattacgcagactccctgaagggtcgattcaccatctccagagacaattccaacaacaccctgtattgcaaatgaacagcctgagaactgaagacacggctatctattactgtgcgagagatcagtccggacgacgaaatgactacggtggtaaccttccagactactggggccagggaaccctggtcaccgtctcctcagcctccaccaaggcccatcggtcttcccctggcnccctcctcc

SEQ ID NO: 454929 - DNA, 501 bp, Homo sapiens
  misc_feature: HEFZJCU01EZ89O.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccgggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaaggactacttccg

SEQ ID NO: 454930 - DNA, 477 bp, Homo sapiens
  misc_feature: HEFZJCU01DCWPI.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagacacgctgtatctgcaaatgaacagcctgagagctgaagacacggctgtgttttactgtgcgagagaga

SEQ ID NO: 454931 - DNA, 515 bp, Homo sapiens
  misc_feature: HEFZJCU01EGR7P.48.57.F02.1.454.heavy.3.raw
agtatacatacacgaccggtgctcgatttagctcgatatagttgggtttggggggaagaggaagactgacggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgacgagcacagcggccctgggctgcctggtcaaggactactcctatgta

SEQ ID NO: 454932 - DNA, 498 bp, Homo sapiens
  misc_feature: HEFZJCU01ACYDB.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaaggcccatcggtcttcccctggcgccctgctccaggagcacctccgagagcacagcggccctgggctgcctggtcaaggactactcctacgtcgtat

SEQ ID NO: 454933 - DNA, 521 bp, Homo sapiens
  misc_feature: HEFZJCU01BAAIJ.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccttggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaaggcccatcggtcttcccctggccg

SEQ ID NO: 454934 - DNA, 411 bp, Homo sapiens
  misc_feature: HEFZJCU01CO5LW.51.60.F05.1.454.heavy.3.raw
cgatcgtatacacgaccggtgctcgatttagtacgtcatcagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactgggccggggaaccctggtcaccgtctcctcagcctccaccaagggcccatcggtcttccccctggcaccctcctccaagagcacctctggggcacagcggccctgggctgcctggtcaaggactacttcctcgtagcact

SEQ ID NO: 454935 - DNA, 382 bp, Homo sapiens
  misc_feature: HEFZJCU01EUXD3.47.60.F05.1.454.heavy.3.raw
agctcacgtacacgaccggtgctcgatttagtacgtcatcagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactgggccagggagtccttgtcaccgtctcctcagcctccaccaagggcccatcggtcttccccctggcaccctcctccaagagcacctctgggggcacagcggccctgggctgcctggtcaaggactacttcctacgtgagct

SEQ ID NO: 454936 - DNA, 514 bp, Homo sapiens
  misc_feature: HEFZJCU01BGM0K.11.71.G05.1.454.heavy.3.raw
  modified_base (470)..(470): a, c, t, g, unknown or other
cgagagataccacgaccggtgctcgatttagtgtcgtcgcaagagagaggagcccagcactagaagtcggcggtgtttccattcggtgatcagcactgaacacagaggactcaccatggagtttgggctgagcgtggtttcgtcgtaggctctttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatgtgacttctattcagactccgtgaagggccgattcaccgtctccagagacaattccaggcacacgctgtatctgcaaatgaacagcctgagagccgaggacacgccggtatgttctagttagcggtaaagngtaacgggctataatagtgccgtacgtaacccgggtgggttacg

SEQ ID NO: 454937 - DNA, 518 bp, Homo sapiens
  misc_feature: HEFZJCU01B2XYW.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtctgggggcctagggactacggtcaccgtctcctcagcctccaccaagggcccatcggtccttccccctggccta

SEQ ID NO: 454938 - DNA, 494 bp, Homo sapiens
  misc_feature: HEFZJCU01BPN7O.53.25.C03.1.454.heavy.3.raw
cgcgtatacacacgaccggtgctcgatttagtagtgtagatttgggtttgggggggtccctgagactctcctgtgcagcctctggattcaccttcagtatttatagcatgaattggatccgccaggctccagggaaggggctcgagtgggtctcatccattagtagtagtagtagttacaaatactacgcagactcagtgaagggccgattcaccgtctccagagacaacgccaagaactcactgtatctgcaaatgaatagcctgagagccgaggacacggctgtatatttctgtgcgagagatgacccatataacagtgactactactctgtggatgatgcttttgatgtctggggccaagggacaatagtcaccgtctcttcagcctccaccaagggcccatcggtcttcccctggcaccctcctccaagagcacctctgggggcacagcggcctgggctgcctggtcaaggactacttcctcgtactgcg

SEQ ID NO: 454939 - DNA, 513 bp, Homo sapiens; identical to SEQ ID NO: 447518
  misc_feature: HEFZJCU01CHC1I.19.67.G01.1.454.heavy.3.raw

SEQ ID NO: 454940 - DNA, 533 bp, Homo sapiens
  misc_feature: HEFZJCU01ATY9D.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttattggggccagggagcctggtcaccg

SEQ ID NO: 454941 - DNA, 493 bp, Homo sapiens
  misc_feature: HEFZJCU01A1FAV.4.7.A07.1.454.heavy.3.raw
agcactgtagcacgaccggtgctcgatttagcacgtgtcgcaggggctgagagaggagcccagccctgggattttcaggtgttttcatttggttgatcaggactgaacagagagaactcaccatggagtctgggctgagcgtggcgttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaagggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagatttggggaatgaccactc

SEQ ID NO: 454942 - DNA, 489 bp, Homo sapiens
  misc_feature: HEFZJCU01BF4TS.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcagcctccaccaagggcccatcggtcttcccctggcaccctcctccaagagcacctctgggggcacagcggccctgggctgcctggtcaaggactacttcccatactcgta

SEQ ID NO: 454943 - DNA, 534 bp, Homo sapiens
  misc_feature: HEFZJCU01DSXRX.15.87.H10.1.454.heavy.3.raw
tctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaagaacttactgtatctgcaaatgaacagcctgagaggcgaggacacggctctgtattactgtgcgaggatacctcctctggcgggccaggtttcctacggcatggacgtctggggccaagggaccacggtcaccgtctcctcagcctccaccaagggcccatcggtcttccccctggccaccctcctccaagagcacctctgggggcacagcggccctgggctgcct

SEQ ID NO: 454944 - DNA, 491 bp, Homo sapiens
  misc_feature: HEFZJCU01AQ89T.15.67.G01.1.454.heavy.3.raw
tctacgtagccacgaccggtgctcgatttagagtatacatattgggtttgggggggtccctgagactctcctgtgcagtctctggattcacccttagaagttattggatgacctgggtccgccaggctccagggaaggggctggagtgggtggccaacataaacaaagacggaagtcagaaaactatgtggactctgtgaacggccgattcaccatctccagagacaacgccaagaattcactgtatttgcaaatgaacagcctgagaggcgaggacacggccgtgtattattgtgcgcgagatgatagtagactctacagtagcaggtggtatgatgcttttgatatgtggggccaagggacagtggtcaccgtcacttcagcctccaccaagggcccatcggtcttcccctggcgccctgctccaggagcacctccgagagcacagcggccctgggctgcctggtcaaggactacttccgctacgtaga

SEQ ID NO: 454945 - DNA, 526 bp, Homo sapiens
  misc_feature: HEFZJCU01DIWS3.49.37.D04.1.454.heavy.3.raw
agtcgagagacacgaccggtgctcgatttagtagcatactgttgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatggggtggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactggggccaggggaaccccggtcaccgtctcctctgcctccaccg

SEQ ID NO: 454946 - DNA, 519 bp, Homo sapiens
  misc_feature: HEFZJCU01CRXHY.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggccaccctcctccaagagcacctctgggggcacagcggcctgggctgcctggtcaaggactacttcctagagacacg

SEQ ID NO: 454947 - DNA, 519 bp, Homo sapiens
  misc_feature: HEFZJCU01CF6WV.47.78.H01.1.454.heavy.3.raw
agctcacgtacacgaccggtgctcgatttagtgtgagtagtttgggtttggggctctgggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttcctttcagtcaagtctggataagctgggtccgccaggctccagggatgggcctggagtgggttggccgtgtcaagagcagaactgatggtgcgacatctgaatacgctgcacccgtgaaaggcagattcaccatctccagagatgattcaataaatatgtcatatctacaaatggatagcctgaaaatcgaggatacaggtgtttattactgttccacaggggaatgcggttctctggggccgagggact

SEQ ID NO: 454948 - DNA, 403 bp, Homo sapiens; identical to SEQ ID NO: 444658
  misc_feature: HEFZJCU01B6483.14.60.F05.1.454.heavy.3.raw

SEQ ID NO: 454949 - DNA, 527 bp, Homo sapiens
  misc_feature: HEFZJCU01BR3ZQ.17.34.D01.1.454.heavy.3.raw
cgtagactagcacgaccggtgctcgatttagatcgtctgtgttgggtttggggacaaaacaaccagattcctcctctaaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattacgaacacagtaatctgagctgaacagcctgtcatctgaggacacgggcttctacttctgtgcgaggagtaattactataacactgctcctttttacacctcccttgacttctggggccatggaacccggtcaccgt

SEQ ID NO: 454950 - DNA, 397 bp, Homo sapiens; identical to SEQ ID NO: 444534
  misc_feature: HEFZJCU01DOMG4.18.1.A01.1.454.heavy.3.raw

SEQ ID NO: 454951 - DNA, 506 bp, Homo sapiens; identical to SEQ ID NO: 444696
  misc_feature: HEFZJCU01B4UIT.16.34.D01.1.454.heavy.3.raw

SEQ ID NO: 454952 - DNA, 540 bp, Homo sapiens
  misc_feature: HEFZJCU01C3Y3C.15.87.H10.1.454.heavy.3.raw
tctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaagaacttactgtatctgcaaatgaacagcctgagaggcgaggacacggctctgtattactgtgcgaggatacctcctctggcgggccaggtttcctacggcatggacgtctggggccaagggaccacggtcaccgtctcctcagcctccaccaagggcccagtcggtcttcccctggccaccctcctccaagagcacctctggggggcacagcggccctgggctgcctggtcg

SEQ ID NO: 454953 - DNA, 336 bp, Homo sapiens; identical to SEQ ID NO: 444510
  misc_feature: HEFZJCU01DI0AB.3.31.C09.1.454.heavy.3.raw

SEQ ID NO: 454954 - DNA, 538 bp, Homo sapiens
  misc_feature: HEFZJCU01CO6BE.52.9.A09.1.454.heavy.3.raw
cgcagtacgacacgaccggtgctcgatttagcgagacgcgcagggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatgaaaactacgcccctggcgctatggacgtctgggccaagggaccacggtcaccgtctcctcagcctccaccaacgggcccatcggtcttcccctc

SEQ ID NO: 454955 - DNA, 522 bp, Homo sapiens; identical to SEQ ID NO: 451893
  misc_feature: HEFZJCU01CYZ46.12.40.D07.1.454.heavy.3.raw

SEQ ID NO: 454956 - DNA, 517 bp, Homo sapiens
  misc_feature: HEFZJCU01EPDIG.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctcaccaaggcccatcggtctcccctgcg

SEQ ID NO: 454957 - DNA, 495 bp, Homo sapiens
  misc_feature: HEFZJCU01A4O8W.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtgcggtgactgctattgactactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 454958 - DNA, 491 bp, Homo sapiens; identical to SEQ ID NO: 447981
  misc_feature: HEFZJCU01B8V1T.47.85.H08.1.454.heavy.3.raw

SEQ ID NO: 454959 - DNA, 480 bp, Homo sapiens; identical to SEQ ID NO: 446171
  misc_feature: HEFZJCU01C7KBQ.22.36.D03.1.454.heavy.3.raw

SEQ ID NO: 454960 - DNA, 509 bp, Homo sapiens
  misc_feature: HEFZJCU01CXA90.48.81.H04.1.454.heavy.3.raw
agtatacatacacgaccggtgctcgatttagtagtgtagattcgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggagttatcatctactactttgtaa

SEQ ID NO: 454961 - DNA, 522 bp, Homo sapiens
  misc_feature: HEFZJCU01ANDZU.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcattacttgacccctggggccggggaaccctggtcaccgtctcccaccctccaccaagggcccatcggtcttcccctggcaccctcctccaagagcacctctgggggcacagcggcctggctgcctggtcaaggactacttcccatactcgta

SEQ ID NO: 454962 - DNA, 409 bp, Homo sapiens
  misc_feature: HEFZJCU01EAYAY.3.41.D08.1.454.heavy.3.raw
agacgcactccacgaccggtgctcgatttagtcacgcgagaaagggaaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgatagaaacttacgatttttggagtggttattatactccccgggatcttgactactggggccaggggaccctggtcaccgtctcctcagcttccaccaagggcccatcggtcttccccctggcgccctgctccaggagcacctctgggggcacagcggccctgggctgcctggtcaaggactacttccgagtgcgtct

SEQ ID NO: 454963 - DNA, 515 bp, Homo sapiens
  misc_feature: HEFZJCU01BZL4N.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggcctggctgcctggcaaggactacttccagacgtatca

SEQ ID NO: 454964 - DNA, 499 bp, Homo sapiens
  misc_feature: HEFZJCU01D46UF.11.73.G07.1.454.heavy.3.raw
cgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttcaaaagtttcgaaatgagctgggtccgccaggctcctgggaaggggccggagtggatttcatacatcagtagtagtggtaacaccttgtactatgcagactctgtgaagggccgattcaccatctccagagacaacgccaagaattcactgtttctgcaaatgaacagcctgagagacgaggatacggctatttactattgtgcgcgatcgacaagaaaagcggtggcctatc

SEQ ID NO: 454965 - DNA, 545 bp, Homo sapiens
  misc_feature: HEFZJCU01CFXKQ.52.73.G07.1.454.heavy.3.raw
cgcagtacgacacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatagaaaactacgcccctggcgctatggacgtctggggccgaagggaccacggtcaccgtctcctcacgcctccaccaaacgggcccactcggtcttccccctc

SEQ ID NO: 454966 - DNA, 531 bp, Homo sapiens; identical to SEQ ID NO: 446857
  misc_feature: HEFZJCU01EN0FP.7.78.H01.1.454.heavy.3.raw

SEQ ID NO: 454967 - DNA, 509 bp, Homo sapiens
  misc_feature: HEFZJCU01BM62I.14.71.G05.1.454.heavy.3.raw
cgtctagtaccacgaccggtgctcgatttagtgtcgtcgcaagagagaggagcccagccctgggattttcaggtgttttcattcggtgatcaggactgaacagagagaactcaccatggagtttgggctgagctggcttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagtatttttggagttggttattagtacctttgacttcgg

SEQ ID NO: 454968 - DNA, 506 bp, Homo sapiens
  misc_feature: HEFZJCU01C6JZ1.11.6.A06.1.454.heavy.3.raw
cgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccgggggggtcccttagactctcctgtgcagcctctggcatcactttcagtgacgcctggatgagctgggtccgccaggctccagggaaggggctggagtgggttggccgtattaaaagcgaggctgctggtgggacaacagactacgctgcacccgtgaagggcagattcaccatctccagagatgattcaaggagcacagtgtttctacaaatgaacagcctgactgccgggggacactgccgtgtattactgtgccagcagcagcacctggccactatatttctttg

SEQ ID NO: 454969 - DNA, 551 bp, Homo sapiens
  misc_feature: HEFZJCU01CDGJW.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctggggaggcttggtacaggccggggggtccctgagactctcctgtgcagcctctggattcaattttaacagcttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcggaggacacggccctttattactgtgcgaaggatcgcccctataatggtggctggagtcgggggtagtttgggtttccgtgggggtccacggggtaacccctgggt

SEQ ID NO: 454970 - DNA, 494 bp, Homo sapiens
  misc_feature: HEFZJCU01EM3YJ.51.27.C05.1.454.heavy.3.raw
cgatcgtatacacgaccggtgctcgatttagacgcgatcgaagggtttggggtctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtacaccctctggattcaccttcagtaactatgcaatgcactgggtccgccaggctccaggcaaggggctggactgggtggcaggtatatcatatgatggaagcaataaatactacgcagactccgtgaagggccgattcaccatctccagagacagttccgatgacacagtctatctgcaaatgaacagcctgagagctgaggacacggctcttttttactgtgcgccaggaagcagtggctgg

SEQ ID NO: 454971 - DNA, 524 bp, Homo sapiens
  misc_feature: HEFZJCU01CKH2B.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaacgggcccatcggtcttccccctggccg

SEQ ID NO: 454972 - DNA, 524 bp, Homo sapiens
  misc_feature: HEFZJCU01CORYD.12.40.D07.1.454.heavy.3.raw
  modified_base (358)..(358): a, c, t, g, unknown or other
atacgacgtacacgaccggtgctcgatttagtgatagagcgtaacaacagagggctcaccatggagtttgggctgagctgggttttcctcgttgctcttttaagagatgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacacccttttanctgcaaatagacagccctgagaccagacgacacggctgtctattattgcgcgagagagacacacgaacctactggccaatactatgggggcttgttctggggccaggggaccctggtcatcgtctccccagcctccaccaaggcccatcggtcttccccgtggccg

SEQ ID NO: 454973 - DNA, 380 bp, Homo sapiens; identical to SEQ ID NO: 445304
  misc_feature: HEFZJCU01EFGDK.3.26.C04.1.454.heavy.3.raw

SEQ ID NO: 454974 - DNA, 490 bp, Homo sapiens
  misc_feature: HEFZJCU01DUUYB.19.53.E09.1.454.heavy.3.raw
tactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtat

SEQ ID NO: 454975 - DNA, 523 bp, Homo sapiens
  misc_feature: HEFZJCU01CP29A.4.59.F04.1.454.heavy.3.raw
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctccctgaggctgagctctgtgaccgccgcggacacggccgtgtatttctgtgcgagatctttcgattttggagtggtaaccccttggctactggggccagggaaccctggtcaccgtctcttcagcctccaccaggg

SEQ ID NO: 454976 - DNA, 492 bp, Homo sapiens
  misc_feature: HEFZJCU01CSKEJ.51.1.A01.1.454.heavy.3.raw
cgatcgtatacacgaccggtgctcgatttagacgtctcatcagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaatatatactatgtagactccgtgaaggccgattcatcatctccagagacaattccgagaacacgctgtatctgcaaatgaacagcctgagagttgaggacacggctgtgtattattgtgcgaacttaatcaggaggacaacggtccg

SEQ ID NO: 454977 - DNA, 505 bp, Homo sapiens
  misc_feature: HEFZJCU01BZH11.10.23.C01.1.454.heavy.3.raw
catagtagtgcacgaccggtgctcgatttagtacacgtgattagggattgggaggcttggtacagcctggcaggtccctgagactctcctgtgcagcctctggattcagctttgatgaatatgccatggactgggtccggcaagttccagggaagggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagagggagtcagggtttcaactattatagtagtggttatgactactggggccagggaaccctggtcaccgtctcctcagcctccaccaagggcccatcggtcttcccctggccgccctgctccaggagcacctccgagagcacagcggccctgggctgcctggtcaaggactacttcccactactatg

SEQ ID NO: 454978 - DNA, 496 bp, Homo sapiens
  misc_feature: HEFZJCU01EZW8K.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctggctgcctggtcaaggactacc

SEQ ID NO: 454979 - DNA, 505 bp, Homo sapiens
  misc_feature: HEFZJCU01BHYET.14.78.H01.1.454.heavy.3.raw
cgtctagtaccacgaccggtgctcgatttagtgtgagtagtttgggtttgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcatgttttagaagttggggcttttgaccactggggccagggaaccctggtcaccgtctcttcagcctccaccaagggcccatcggtcttcccctggcaccctcctccaagagcacctctgggggcacagcggccctgggctgcctggtcaaggctacttccgtactagacg

SEQ ID NO: 454980 - DNA, 484 bp, Homo sapiens; identical to SEQ ID NO: 446564
  misc_feature: HEFZJCU01BZ0JZ.19.13.B02.1.454.heavy.3.raw

SEQ ID NO: 454981 - DNA, 500 bp, Homo sapiens
  misc_feature: HEFZJCU01CWH9V.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctgtctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgctttgatatctggggccaaggggac

SEQ ID NO: 454982 - DNA, 494 bp, Homo sapiens
  misc_feature: HEFZJCU01BRISS.52.34.D01.1.454.heavy.3.raw
cgcagtacgacacgaccggtgctcgatttagatcgtctgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttcccctggcaccctcctccaagagcacctctgggggcacagtggccctgggctgcctggtcaaggactacttcctatacgatcg

SEQ ID NO: 454983 - DNA, 530 bp, Homo sapiens
  misc_feature: HEFZJCU01D38G5.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaggg

SEQ ID NO: 454984 - DNA, 414 bp, Homo sapiens; identical to SEQ ID NO: 444982
  misc_feature: HEFZJCU01DFCMU.5.23.C01.1.454.heavy.3.raw

SEQ ID NO: 454985 - DNA, 508 bp, Homo sapiens; identical to SEQ ID NO: 445594
  misc_feature: HEFZJCU01DC7B7.17.25.C03.1.454.heavy.3.raw

SEQ ID NO: 454986 - DNA, 524 bp, Homo sapiens
  misc_feature: HEFZJCU01BUURS.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggcgccctgctccaggagcacctccgacgagcacagcggccctgggccg

SEQ ID NO: 454987 - DNA, 518 bp, Homo sapiens
  misc_feature: HEFZJCU01B5SYI.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaaggcccatcggtcttcccctggccaccctcctccaagagcacctctgggggcacagcggccctgggctgcctggtcaaggactacttcctagagacacg

SEQ ID NO: 454988 - DNA, 500 bp, Homo sapiens
  misc_feature: HEFZJCU01AEVC3.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgagaggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactactcctatgtatact

SEQ ID NO: 454989 - DNA, 533 bp, Homo sapiens
  misc_feature: HEFZJCU01CORHY.15.87.H10.1.454.heavy.3.raw
tctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaagaacttactgtatctgcaaatgaacagcctgagaggcgaggacacggctctgtattactgtgcgaggatacctcctctggcgggccaggttcctacggcatggacgtctggggccaagggaccacggtcaccgtctcctcagcctccaccaagggcccatcggtcttcccctggcaccctcctccagagcacctctgggggcacagcggccctgggctgcctggt

SEQ ID NO: 454990 - DNA, 500 bp, Homo sapiens
  misc_feature: HEFZJCU01EH63F.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgacgaaagatttctatagaggtgacgtac

SEQ ID NO: 454991 - DNA, 483 bp, Homo sapiens; identical to SEQ ID NO: 444532
  misc_feature: HEFZJCU01B2LYF.47.59.F04.1.454.heavy.3.raw

SEQ ID NO: 454992 - DNA, 439 bp, Homo sapiens
  misc_feature: HEFZJCU01C3J7P.48.23.C01.1.454.heavy.3.raw
agtatacatacacgaccggtgctcgatttagtacacgtgattagggattgggtgcgccaggcccccggacaaagccttgagtggatggggtggctcaacgctggcgatggtcagacaaagtattcacagaagttccagggcagagtcaccatcaccagggacacgtccgcgagtagtgtcttcatggagctgcgcagtctgagatcggaagacacggcagtatattactgtgcgagaggcggatattgtcgtcgaggtgactgctacagtcaaaatcgtgagtcgtggttcgacccctggggccagggtaccctggtcattgtctcctcagcttccaccaagggcccatcggtcttccccctggcgccctgctccagagcacctctgggggcacagcggccctgggctgcctggtcaaggactacttcctatgtatact

SEQ ID NO: 454993 - DNA, 503 bp, Homo sapiens
  misc_feature: HEFZJCU01CAK13.17.25.C03.1.454.heavy.3.raw
cgtagactagcacgaccggtgctcgatttagtagtgtagatttggttttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttctc

SEQ ID NO: 454994 - DNA, 506 bp, Homo sapiens; identical to SEQ ID NO: 444696
  misc_feature: HEFZJCU01B0Y4I.16.34.D01.1.454.heavy.3.raw

SEQ ID NO: 454995 - DNA, 515 bp, Homo sapiens
  misc_feature: HEFZJCU01CT01Q.4.39.D06.1.454.heavy.3.raw
agcactgtagcacgaccggtgctcgatttagtgacatctcgcagttctttgggttttggggggaagtgtggtacggcctggggggtccctgagactctcctgtacagcctctggattctcctttgatgattatggcatgagctgggtccgccaagctccagggaaggggctggagtgggtgtctggtatgaattggagtggcggtagtacagcttatgcagactctgtgaagggccgattcaccatctccagagacaacgccaagaactccctgtatctgcaattgaacagtctgagagccgaggacacggccttgtattactgtgcgagaacatttagggtgtgtagtggtaacagctgctattcgtcgactgggtttgactactggggccagggagccctggtcaccgtctcctcagcctccaccaagggcccatcggtcttcccctcggcgccctgctccaggagcacctccgacgaggcacagcggccctgggctgcctggtcaaggacta

SEQ ID NO: 454996 - DNA, 400 bp, Homo sapiens; identical to SEQ ID NO: 445493
  misc_feature: HEFZJCU01DJPB3.13.4.A04.1.454.heavy.3.raw

SEQ ID NO: 454997 - DNA, 517 bp, Homo sapiens; identical to SEQ ID NO: 445684
  misc_feature: HEFZJCU01CT8D6.9.34.D01.1.454.heavy.3.raw

SEQ ID NO: 454998 - DNA, 495 bp, Homo sapiens
  misc_feature: HEFZJCU01BMRF4.40.1.A01.1.454.heavy.3.raw
tctagcgactcacgaccggtgctcgatttagacgtctcatcaggggagctctgggagacgagcccagcactggaagtcgccggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcctgtgcagcctctggattcattttcagtaactatgctatgcactgggtccgccagactccgggcaaggggctggagtgggtggcaattatctcatatgatgaaagtcaagaatactacgcagactccgtgaagggccgattcaccatctccagagacaattccaagaacacactgaatctacaaatgaacagcctcagacctgaggactcggctgtctatttctgtgcgagagggggtgactatcgattcc

SEQ ID NO: 454999 - DNA, 518 bp, Homo sapiens; identical to SEQ ID NO: 444718
  misc_feature: HEFZJCU01AMXTJ.9.34.D01.1.454.heavy.3.raw

SEQ ID NO: 455000 - DNA, 495 bp, Homo sapiens
  misc_feature: HEFZJCU01EAZNR.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtattgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 455001 - DNA, 513 bp, Homo sapiens
  misc_feature: HEFZJCU01AJSYH.13.87.H10.1.454.heavy.3.raw
tcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagataccaaccccttacgtattttggagtggtttac

SEQ ID NO: 455002 - DNA, 387 bp, Homo sapiens; identical to SEQ ID NO: 444930
  misc_feature: HEFZJCU01BZGO9.16.59.F04.1.454.heavy.3.raw

SEQ ID NO: 455003 - DNA, 513 bp, Homo sapiens
  misc_feature: HEFZJCU01BYVO0.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttctcaaatgaacagcctgagagccgatgacacggccgtgtattactgtgcgagagatggggcccacgaacgttactacgctatggacgtctggggaccg

SEQ ID NO: 455004 - DNA, 541 bp, Homo sapiens
  misc_feature: HEFZJCU01EOXTK.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatcccctgaaagcgtcaactactactactacggtatggacctctggggccaagggacccg

SEQ ID NO: 455005 - DNA, 511 bp, Homo sapiens
  misc_feature: HEFZJCU01DYMKO.9.14.B03.1.454.heavy.3.raw
tgatacgtctcacgaccggtgctcgatttagtgtgagtagtttgggtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagccggcccgtgggctgcctggtcaaggactacttccagacgtatca

SEQ ID NO: 455006 - DNA, 536 bp, Homo sapiens
  misc_feature: HEFZJCU01ECJ0O.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagacgacccctccgatagcagtggctggtccacgttaggtttgacttactgggggccaggggaacgcgttggtccaccggtctccctcacgcctcccg

SEQ ID NO: 455007 - DNA, 531 bp, Homo sapiens
  misc_feature: HEFZJCU01C12T6.16.87.H10.1.454.heavy.3.raw
tgtactactccacgaccggtgctcgatttagcagtactgcgttgggtttgggggccccagccctgggattcccagctgtttctgcttgctgatcaggactgcacacagggagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcgaccgtctccagagacaacaccaagaacacactatatctgcagattgacagtctgagacccgaggacacggctgtgtattactgtgcaaggcagttcgtggaaacagttatggtttggggggagttggggttttttttcgttactacggg

SEQ ID NO: 455008 - DNA, 314 bp, Homo sapiens
  misc_feature: HEFZJCU01D90XW.49.8.A08.1.454.heavy.3.raw
agtcgagagacacgaccggtgctcgatttagcatactctacagggacaattccgagaacacgctgtatctgcaaatgagcagcctgagagctgaggacacggctgtgtattactgtgcgaacttaatcacggaggacaacggtgacccccgtccgctcggtgcggaggtctggggccaagggaccacggtcatcgtctcctcagcctccacctaagggcccatcggtcttccccctggcaccctcctccaagagcacctctgggggcacagcggccctgggctgcctggtcaaggactacttcctctctcgact

SEQ ID NO: 455009 - DNA, 531 bp, Homo sapiens
  misc_feature: HEFZJCU01BH6VE.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaacgggcccatccggtccttccccctcggccaccctcctccaacgagcacctctgggggcacgagcc

SEQ ID NO: 455010 - DNA, 396 bp, Homo sapiens; identical to SEQ ID NO: 445818
  misc_feature: HEFZJCU01CDNVW.16.68.G02.1.454.heavy.3.raw

SEQ ID NO: 455011 - DNA, 518 bp, Homo sapiens
  misc_feature: HEFZJCU01A3541.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactactccagacgtatca

SEQ ID NO: 455012 - DNA, 498 bp, Homo sapiens
  misc_feature: HEFZJCU01C90YM.13.37.D04.1.454.heavy.3.raw
  modified_base (473)..(473): a, c, t, g, unknown or other
  modified_base (487)..(487): a, c, t, g, unknown or other
tcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctggggagccgaggacacggccgttttancactgtgcgaaagntattgtaatga

SEQ ID NO: 455013 - DNA, 522 bp, Homo sapiens
  misc_feature: HEFZJCU01EVMLJ.48.34.D01.1.454.heavy.3.raw
agtatacatacacgaccggtgctcgatttagatcgtctgtgttgggtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacc

SEQ ID NO: 455014 - DNA, 512 bp, Homo sapiens
  misc_feature: HEFZJCU01AW0VR.52.78.H01.1.454.heavy.3.raw
cgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctaccaaatgagcagcctgacatccgaggacacggccgtgtattactgtgcgagagttctttgggatggttgtcgtttgcacc

SEQ ID NO: 455015 - DNA, 494 bp, Homo sapiens
  misc_feature: HEFZJCU01BVTL0.48.82.H05.1.454.heavy.3.raw
agtatacatacacgaccggtgctcgatttagtcgagctctctcgcgggcacgaccggtgctcgatttagtacacacacttagggattggggatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgagcaccatatccgtagacacgtccaagaaccaattctcctgaagctgagctctgtgaccgccgcagacacggctgtctattactgtgcgaggccccgagcgcagtggcttttgatgcctttg

SEQ ID NO: 455016 - DNA, 316 bp, Homo sapiens; identical to SEQ ID NO: 444479
  misc_feature: HEFZJCU01CNUHW.47.84.H07.1.454.heavy.3.raw

SEQ ID NO: 455017 - DNA, 500 bp, Homo sapiens; identical to SEQ ID NO: 446033
  misc_feature: HEFZJCU01DURBZ.11.27.C05.1.454.heavy.3.raw

SEQ ID NO: 455018 - DNA, 515 bp, Homo sapiens
  misc_feature: HEFZJCU01DS2BZ.10.59.F04.1.454.heavy.3.raw
catagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggctccatcaacagtggtgacaactggtggggctgggtccgccagcccccagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaatgtactttgaccacgtggggccagggagccctggtccaccgtctcctcacg

SEQ ID NO: 455019 - DNA, 403 bp, Homo sapiens; identical to SEQ ID NO: 444540
  misc_feature: HEFZJCU01CW8TH.16.72.G06.1.454.heavy.3.raw

SEQ ID NO: 455020 - DNA, 396 bp, Homo sapiens; identical to SEQ ID NO: 444426
  misc_feature: HEFZJCU01AITGI.18.31.C09.1.454.heavy.3.raw

SEQ ID NO: 455021 - DNA, 501 bp, Homo sapiens
  misc_feature: HEFZJCU01DLX5S.18.39.D06.1.454.heavy.3.raw
  modified_base (469)..(469): a, c, t, g, unknown or other
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaagggcccatcggtcttcccctggcgcctgctccagagcacctctggggcacngcgcctgggctgcctgtcaggactactccata

SEQ ID NO: 455022 - DNA, 482 bp, Homo sapiens
  misc_feature: HEFZJCU01D8FY7.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctcaccaagggcccatcggtcttcccctggcaccctcctccaagagcacctctgggggcacagcggccctgggctgcctggtcaaggactacttccgtatctctcg

SEQ ID NO: 455023 - DNA, 395 bp, Homo sapiens; identical to SEQ ID NO: 444517
  misc_feature: HEFZJCU01APH7W.16.68.G02.1.454.heavy.3.raw

SEQ ID NO: 455024 - DNA, 514 bp, Homo sapiens
  misc_feature: HEFZJCU01DDO8H.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacgaatgaccaatatggaccctgtggacacagccacatattactgttcacgctctatggttcggggagttattagtccctactttgactactggggccagggaactctggtcaccgtctccgcagcctcaccaagggcccc

SEQ ID NO: 455025 - DNA, 490 bp, Homo sapiens; identical to SEQ ID NO: 454974
  misc_feature: HEFZJCU01A9OR9.19.53.E09.1.454.heavy.3.raw

SEQ ID NO: 455026 - DNA, 489 bp, Homo sapiens; identical to SEQ ID NO: 444591
  misc_feature: HEFZJCU01DRN9B.18.70.G04.1.454.heavy.3.raw

SEQ ID NO: 455027 - DNA, 383 bp, Homo sapiens; identical to SEQ ID NO: 448596
  misc_feature: HEFZJCU01EVHMH.9.46.E02.1.454.heavy.3.raw

SEQ ID NO: 455028 - DNA, 507 bp, Homo sapiens; identical to SEQ ID NO: 445781
  misc_feature: HEFZJCU01DSBNA.48.44.D11.1.454.heavy.3.raw

SEQ ID NO: 455029 - DNA, 510 bp, Homo sapiens
  misc_feature: HEFZJCU01DDCEW.2.33.C11.1.454.heavy.3.raw
acgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttcaatacagtgtggatgaattgggtccgccaggctccagggaagggctggagtgggttggccatataaaagtaagactgctggtgagacaacagactacgctgctgccttcagaggcagattcaccatcttcagagatgaatcacagagcactctgtttctgcaaatgaacagcctggaagacgcgggacacagccatgtattattgtacattaggacactatagtccctgggggccaggggaaccctcg

SEQ ID NO: 455030 - DNA, 446 bp, Homo sapiens
  misc_feature: HEFZJCU01C0TQ3.51.38.D05.1.454.heavy.3.raw
cgatcgtatacacgaccggtgctcgatttagtatctgatagttgggtttgggtagttgggtttggggggaagaggaagactgacggtccccccaggagttcaggtgctggactgggtggcaggcatatcatttgatggaagcaagaagtactatgcagactccgtgaagggccgattcaccatctccagagacagttccgatgacacagtctatctacacatgagcagtgtgagacctgacgacacggctcttttttactgtgcgccaggaagcagtggctggccacatcatgcttttgatatctggagccaagggacaatggtcatcgtctcttcggcctccaccaagggcccatcggtcttcccctggcaccctcctccaagagcacctctgggggcacagcggccctgggctgcctggtcaaggactacttcctcgtagcact

SEQ ID NO: 455031 - DNA, 526 bp, Homo sapiens; identical to SEQ ID NO: 450606
  misc_feature: HEFZJCU01B1MLW.48.4.A04.1.454.heavy.3.raw

SEQ ID NO: 455032 - DNA, 497 bp, Homo sapiens; identical to SEQ ID NO: 445179
  misc_feature: HEFZJCU01C6ND4.12.55.E11.1.454.heavy.3.raw

SEQ ID NO: 455033 - DNA, 539 bp, Homo sapiens
  misc_feature: HEFZJCU01ANQEH.49.10.A10.1.454.heavy.3.raw
agtcgagagacacgaccggtgctcgatttagcgtcgatctcagggggggagacgagcccagcactggaagtcgccggtgtttccattcggtgatcatcactgaacacagaggactcaccatggagtttgggctgagctgggttttcctcgctgctcttttaagagacgtccactgttttgtgggcctggtggagtctggggggggcgtggtccagcccgggaggtccctcagactctcctgtacagacccgacatcttacgtcaggattaataatgtacactggatccgccaggccccaggcaaggggctggagtgggtggcattggtgactcatgtggaagacagaaaattgtacgcagactccgtgaggggccgattcatcatctccaaagactactccaagaatacggtgtatcttcaaatgaatggcctcgttttgcggacacggctgtttattattgtgcgacagggggccccccttctacggagcgatcatactactttgaccactggggccagggaacccgtaggtcaccgt

SEQ ID NO: 455034 - DNA, 510 bp, Homo sapiens; identical to SEQ ID NO: 445542
  misc_feature: HEFZJCU01EJ007.16.21.B10.1.454.heavy.3.raw

SEQ ID NO: 455035 - DNA, 509 bp, Homo sapiens
  misc_feature: HEFZJCU01BKZ2I.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggagtacgagtggcagctccaagtacttac

SEQ ID NO: 455036 - DNA, 491 bp, Homo sapiens; identical to SEQ ID NO: 445531
  misc_feature: HEFZJCU01EM3TA.11.38.D05.1.454.heavy.3.raw

SEQ ID NO: 455037 - DNA, 498 bp, Homo sapiens
  misc_feature: HEFZJCU01EVJCX.53.56.F01.1.454.heavy.3.raw
cgcgtatacacacgaccggtgctcgatttagcagacgtctgaacacacaaagggggagcatcacccagcaaccacatctgtcctccagagaatccccctgagagctccgttccgtcaccatggactgggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgttgcaacctatgcacagaggtttcagggcagggtcaccatgaccgagggacacgtccatcagcacagcctacatggagctacacggccctgagatctgacgacaccggccctgtactttttgtcgtcgagagagtctattaaagtggcgttc

SEQ ID NO: 455038 - DNA, 515 bp, Homo sapiens
  misc_feature: HEFZJCU01C08RY.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagcgtggcgttttcttagtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctggagagccgacgacacggccatatattactgtgcgaaagcaccggcagttagtcacccatactactttgactactggggccaac

SEQ ID NO: 455039 - DNA, 386 bp, Homo sapiens; identical to SEQ ID NO: 454321
  misc_feature: HEFZJCU01DFOPD.10.60.F05.1.454.heavy.3.raw

SEQ ID NO: 455040 - DNA, 515 bp, Homo sapiens
  misc_feature: HEFZJCU01EFPPS.49.20.B09.1.454.heavy.3.raw
agtcgagagacacgaccggtgctcgatttagtgtagtgtgaaggggacccaacaaccacatccctcctcagaagcccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatggatcaccgctggcaatggtgacacaaaatattcagagaagttccagggcagagtctccattaccagggacacagctgcgagtacagggtacatggaactgagtggcctgagatctgaggacacggctgtttattactgtgcgaggagggaagtgggatagttgtggcagctccgaggtcgcccaggcccgggcccttactttgacttacgtc

SEQ ID NO: 455041 - DNA, 506 bp, Homo sapiens; identical to SEQ ID NO: 449588
  misc_feature: HEFZJCU01CWLUW.11.72.G06.1.454.heavy.3.raw

SEQ ID NO: 455042 - DNA, 464 bp, Homo sapiens; identical to SEQ ID NO: 445533
  misc_feature: HEFZJCU01B8N0N.19.10.A10.1.454.heavy.3.raw

SEQ ID NO: 455043 - DNA, 511 bp, Homo sapiens; identical to SEQ ID NO: 448280
  misc_feature: HEFZJCU01C8VMH.16.71.G05.1.454.heavy.3.raw

SEQ ID NO: 455044 - DNA, 480 bp, Homo sapiens
  misc_feature: HEFZJCU01DFS42.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttcccctggcaccctcctccaagagcacctctgggggcacagcgccctgggctgcctggtcaaggactacttcctagagacacg

SEQ ID NO: 455045 - DNA, 379 bp, Homo sapiens; identical to SEQ ID NO: 444450
  misc_feature: HEFZJCU01EE2YR.47.77.G11.1.454.heavy.3.raw

SEQ ID NO: 455046 - DNA, 481 bp, Homo sapiens
  misc_feature: HEFZJCU01BYOB7.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtattttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 455047 - DNA, 516 bp, Homo sapiens
  misc_feature: HEFZJCU01CIJMY.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactacgtgggccagggaactctggtcaccgtctccgcagcctccaccaaggcccatcc

SEQ ID NO: 455048 - DNA, 506 bp, Homo sapiens; identical to SEQ ID NO: 445682
  misc_feature: HEFZJCU01DFUXY.48.44.D11.1.454.heavy.3.raw

SEQ ID NO: 455049 - DNA, 526 bp, Homo sapiens
  misc_feature: HEFZJCU01DVFOF.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggattgactactgggccagggaaccctggtcaccgtctcctcagcctccacagg

SEQ ID NO: 455050 - DNA, 511 bp, Homo sapiens
  misc_feature: HEFZJCU01CFC88.52.78.H01.1.454.heavy.3.raw
  modified_base (450)..(450): a, c, t, g, unknown or other
cgcagtacgacacgaccggtgctcgatttagtgtgagtagtttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacntccgaggacacggccgtgtattactgtgcgagagttctttgggatgttgtcgtttggcacc

SEQ ID NO: 455051 - DNA, 509 bp, Homo sapiens
  misc_feature: HEFZJCU01AIC73.48.19.B08.1.454.heavy.3.raw
  modified_base (481)..(481): a, c, t, g, unknown or other
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactgggctggatccgccagcccccagggaaggggctggagtggagttgggagtatctattatagtgggagtacctactacaacccgtccctcaagagtcgactcaccatatccgtagacacgtccaagaaccagttctccctgaagctgagctctgtgaccgccgcagacacggctgtgtattactgtgcggagggggccggatattgttatagaaccacctgctatctgagctggttcnctgctggggccagggaccctggtcaccg

SEQ ID NO: 455052 - DNA, 395 bp, Homo sapiens; identical to SEQ ID NO: 445227
  misc_feature: HEFZJCU01C4QO3.47.46.E02.1.454.heavy.3.raw

SEQ ID NO: 455053 - DNA, 532 bp, Homo sapiens
  misc_feature: HEFZJCU01EMKMW.8.34.D01.1.454.heavy.3.raw
ctcgcgtgtccacgaccggtgctcgatttagatcgtctgtgttgggtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggaggggggaaccagcgggagttccaagtactcctttgacgtctggggccagggtaccctggtcaccgtctcctcagcctccaccaagggcccatcggtcttcccctggcgccctgctccaggagcacctccgagacgcacg

SEQ ID NO: 455054 - DNA, 482 bp, Homo sapiens
  misc_feature: HEFZJCU01CIXLG.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctgggctgcctggtcaaggactacttcccactacatg

SEQ ID NO: 455055 - DNA, 396 bp, Homo sapiens; identical to SEQ ID NO: 444469
  misc_feature: HEFZJCU01ERKKN.47.46.E02.1.454.heavy.3.raw

SEQ ID NO: 455056 - DNA, 482 bp, Homo sapiens
  misc_feature: HEFZJCU01DZX94.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttccccctggcaccctcctccaagagcacctctggggcacagcggccctggctgcctggtcaaggactacttccgtatctctcg

SEQ ID NO: 455057 - DNA, 492 bp, Homo sapiens; identical to SEQ ID NO: 446787
  misc_feature: HEFZJCU01D26TA.4.7.A07.1.454.heavy.3.raw

SEQ ID NO: 455058 - DNA, 530 bp, Homo sapiens
  misc_feature: HEFZJCU01DPL99.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccactcggtcctttcccccgtggccaccctcctcccaagacgcacctcgtgggggccacgac

SEQ ID NO: 455059 - DNA, 512 bp, Homo sapiens; identical to SEQ ID NO: 445688
  misc_feature: HEFZJCU01D7VHS.3.34.D01.1.454.heavy.3.raw

SEQ ID NO: 455060 - DNA, 408 bp, Homo sapiens
  misc_feature: HEFZJCU01DPDX4.49.41.D08.1.454.heavy.3.raw
agtcgagagacacgaccggtgctcgatttagtcacgcgagaaagggaaagggctggagtggctttcatatatcagcagtagtggtagcaccatcttctacgcagactctgtgaagggccgattcaccatttcccgggacaacgccaagaagtcactatctctgcacatgatcagcctgagagccgaggacacggccatgtatttctgtgcgagagcccctcacggtggtgggactgtaccttattacttctacgctatggacgtctggggccaagggaccacggtcaccgtctcctcaccctccaccaagggcccatcggtcttccccctggcaccctcctccaagagcacctctgggggcacagcggccctgggctgcctggtcaaggactacttcctctctcgact

SEQ ID NO: 455061 - DNA, 491 bp, Homo sapiens; identical to SEQ ID NO: 444592
  misc_feature: HEFZJCU01C7RA0.11.26.C04.1.454.heavy.3.raw

SEQ ID NO: 455062 - DNA, 506 bp, Homo sapiens; identical to SEQ ID NO: 449588
  misc_feature: HEFZJCU01CVJ7J.11.72.G06.1.454.heavy.3.raw

SEQ ID NO: 455063 - DNA, 517 bp, Homo sapiens; identical to SEQ ID NO: 447921
  misc_feature: HEFZJCU01EI9IC.9.34.D01.1.454.heavy.3.raw

SEQ ID NO: 455064 - DNA, 387 bp, Homo sapiens; identical to SEQ ID NO: 445229
  misc_feature: HEFZJCU01CS5RR.11.20.B09.1.454.heavy.3.raw

SEQ ID NO: 455065 - DNA, 391 bp, Homo sapiens; identical to SEQ ID NO: 444514
  misc_feature: HEFZJCU01EA07A.12.24.C02.1.454.heavy.3.raw

SEQ ID NO: 455066 - DNA, 508 bp, Homo sapiens
  misc_feature: HEFZJCU01ESZCM.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggccgccctgctccaggagcacctccgagagcacagcggccctgggctgcctggtcaaggactactccgagtgcgtct

SEQ ID NO: 455067 - DNA, 491 bp, Homo sapiens; identical to SEQ ID NO: 444592
  misc_feature: HEFZJCU01CZ06E.11.26.C04.1.454.heavy.3.raw

SEQ ID NO: 455068 - DNA, 483 bp, Homo sapiens; identical to SEQ ID NO: 444639
  misc_feature: HEFZJCU01ECT95.11.23.C01.1.454.heavy.3.raw

SEQ ID NO: 455069 - DNA, 511 bp, Homo sapiens
  misc_feature: HEFZJCU01ED04O.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtctggggcctagggactacggtcaccgtctcctcagcctccaccaaggcccatcggtcttcccctggc

SEQ ID NO: 455070 - DNA, 538 bp, Homo sapiens
  misc_feature: HEFZJCU01EGGEZ.52.49.E05.1.454.heavy.3.raw
cgcagtacgacacgaccggtgctcgatttagagcgactagcaacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccggacaagggcttgagtggatgggatggatcagcggtgacaacggcaacacaaattatggacagaagttccagggcagagtcaccatgaccgcggacacatccacgaacacagcctacatggagctgaggagcctaagatctgacgacacggccgtttattactgtgtgagagattttagggacctcggcccttgggggagttatcggttactttgactactggggccgagggaacccaggtcaccgtct

SEQ ID NO: 455071 - DNA, 522 bp, Homo sapiens
  misc_feature: HEFZJCU01BFLBQ.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactggggccaggggaagcgttggtcaccgtctcctcagcct

SEQ ID NO: 455072 - DNA, 508 bp, Homo sapiens
  misc_feature: HEFZJCU01AWY7S.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctacttgactactgggccagggaactctgtcacgtctccgcagcctccaccaaggccc

SEQ ID NO: 455073 - DNA, 514 bp, Homo sapiens
  misc_feature: HEFZJCU01EP3N4.13.9.A09.1.454.heavy.3.raw
tcacgtactacacgaccggtgctcgatttagcgagacgcgcagggggggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctgggggaggtttggtacagccagggcggtccctgagactctcctgtataacttctggattcaacttgggtgattatgctatgaactgggtccgccaggctccagggaaggggctggagtgggtaggtttcattaggagcaattctcatgatgggacaacagaatacgccgcgtctgtaaaaggcagattcaccatctcaagagatgagtccagaagcatcgcctttctgcagatgagtagcctgaagaccgaggacacagccatctattactgtgctagagagtattgcagtcctacgacctgctagtgggggtccg

SEQ ID NO: 455074 - DNA, 505 bp, Homo sapiens
  misc_feature: HEFZJCU01EW3LF.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggccgccctcgctccaggagcactccgagagcacagcggcctgggctgcctggtcaggactacttcccactacta

SEQ ID NO: 455075 - DNA, 395 bp, Homo sapiens
  misc_feature: HEFZJCU01BSI0R.16.68.G02.1.454.heavy.3.raw
tgtactactccacgaccggtgctcgatttagtcgatagtgaagggaagggactggagtggattgcctatatctcttacagtgggagcagcaactgcaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 455076 - DNA, 535 bp, Homo sapiens
  misc_feature: HEFZJCU01EMZ0Q.16.27.C05.1.454.heavy.3.raw
  modified_base (522)..(522): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttattcatatgatggaactactcaacactatccagactccggggagggccgattcaccgtctccagagacaattccaagaacagggtgtttctccaagtgattgatctgagaagtgaggacacgggctgtttattactgtgcgtcggtggctgaccgtctcttgactacgtgggggccggggagccccggtnacttcgtcttccc

SEQ ID NO: 455077 - DNA, 534 bp, Homo sapiens
  misc_feature: HEFZJCU01D1SHL.17.28.C06.1.454.heavy.3.raw
  modified_base (522)..(522): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtaatggctgtgtttattggggccaggganccctggtcaccg

SEQ ID NO: 455078 - DNA, 396 bp, Homo sapiens; identical to SEQ ID NO: 444469
  misc_feature: HEFZJCU01EPIAA.47.46.E02.1.454.heavy.3.raw

SEQ ID NO: 455079 - DNA, 532 bp, Homo sapiens
  misc_feature: HEFZJCU01DRIWN.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtcctccccaccctccaacccg

SEQ ID NO: 455080 - DNA, 532 bp, Homo sapiens; identical to SEQ ID NO: 445228
  misc_feature: HEFZJCU01CBV9J.7.78.H01.1.454.heavy.3.raw

SEQ ID NO: 455081 - DNA, 495 bp, Homo sapiens
  misc_feature: HEFZJCU01BRY6S.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactgggggccccggggaccctggtcaccgtctcctcggcctccaccaagggcccatcggtcttcccctggccgccctgctccaggagcacctccgagagcacagcggccctgggctgcctggtcaaggactacttccctacagtgct

SEQ ID NO: 455082 - DNA, 452 bp, Homo sapiens
  misc_feature: HEFZJCU01B21X9.51.37.D04.1.454.heavy.3.raw
cgatcgtatacacgaccggtgctcgatttagtagcatactgttgggtttggggttgggtttggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttcctcgtagcact

SEQ ID NO: 455083 - DNA, 500 bp, Homo sapiens
  misc_feature: HEFZJCU01EY8CX.11.16.B05.1.454.heavy.3.raw
cgagagataccacgaccggtgctcgatttagagctcacgtattgagctctgggagaagagccccagccccagaattccgaggagtttccattcggtgatcagcactgaacacagaggactcaccatggagtttgggctgagctgggttttccttgttgctattatagaaggtgtccagtgtcaggtgcaactggtggaatctgggggaggcttggtcaagcctggggagtccctgagactctcctgtgcagcctctggattctccttcagtgactcctttatgagttggatccgccaggctccagggcaggggctggaatggatttcatacattggtgaaagtggcagtcccatataccacgcagactctgtgaagggccggttcaccatctccagggacaactccaaaaactcactatatctggaaatgactagcctgagactcgaggacacggccgtttattactgtgcgacgcccgccgatagcagcatcatctacg

SEQ ID NO: 455084 - DNA, 396 bp, Homo sapiens; identical to SEQ ID NO: 444568
  misc_feature: HEFZJCU01EE9QQ.47.46.E02.1.454.heavy.3.raw

SEQ ID NO: 455085 - DNA, 513 bp, Homo sapiens
  misc_feature: HEFZJCU01DF9T2.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaaacaaagacggaagtcagaaaaactatgtggactctgtgaacggccgattcaccatctccagagacaacgccaagaattcactgtatttgcaaatgaaacagcctgagaggcgaggacacggccgtgtattatgtgcgcgagatgatagtagactctacagtagcaggtggta

SEQ ID NO: 455086 - DNA, 511 bp, Homo sapiens
  misc_feature: HEFZJCU01ELYYY.13.71.G05.1.454.heavy.3.raw
tcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgacttacgg

SEQ ID NO: 455087 - DNA, 499 bp, Homo sapiens
  misc_feature: HEFZJCU01D8OW6.11.71.G05.1.454.heavy.3.raw
  modified_base (479)..(479): a, c, t, g, unknown or other
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagntttctatagaggtgacgtac

SEQ ID NO: 455088 - DNA, 465 bp, Homo sapiens
  misc_feature: HEFZJCU01DEWZI.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggcccatcggtcttcccctggcgccctgctccaggagcacctccgagagcacagcggccctgggctgcctggtcaaggactacttcccacgacgagta

SEQ ID NO: 455089 - DNA, 528 bp, Homo sapiens
  misc_feature: HEFZJCU01AIG0E.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaaggcccatcggtcttcccctggcaccctcctccagagcacctctgggggcacagcggccctgggctgcct

SEQ ID NO: 455090 - DNA, 504 bp, Homo sapiens
  misc_feature: HEFZJCU01EOXYO.48.43.D10.1.454.heavy.3.raw
agtatacatacacgaccggtgctcgatttagactagcagtaagggggagagaggagccttagccctggattccaaggcctatccacttggtgaccagcactgagcaccgagggttcaccatggaattggggctccgctgggttttcctggttgctgttttagcaggtggcagtgtgacgtgcacctgctggagtcggggggaggcctggtcaagcggggggggtccctgagactctcttgtgaagcctctaaaatcagtctcgagagttccagcatgaactgggtccgccaggctccagggaagggcctggagtgggtctcatccatcagcagtggaggcaaccatatgttgtatgccgactcagtgaggggccgattcagcgtctccagagacaacgccaagatgtcagtatatctggaaatgaacaacctaagagtcgaggacacggctgtctactactgtgcgagagatgtgattccagtgactggtgggtggtactttga

SEQ ID NO: 455091 - DNA, 482 bp, Homo sapiens; identical to SEQ ID NO: 444503
  misc_feature: HEFZJCU01C6MFV.7.10.A10.1.454.heavy.3.raw

SEQ ID NO: 455092 - DNA, 379 bp, Homo sapiens
  misc_feature: HEFZJCU01ETBVY.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 455093 - DNA, 520 bp, Homo sapiens
  misc_feature: HEFZJCU01B285U.12.58.F03.1.454.heavy.3.raw
atacgacgtacacgaccggtgctcgatttagtctgatcgagaagggaaaggggcagagaggagccttagccctggactccaaggcctttccacttggtgatcagcactgagcacagaggactcaccatggaattggggctgagctgggttttccttgttgctattttagaaggtgtccagtgtgagggacaattggtggagtctggggaggcttggtccagccgggggggtccctgagactctcctgtacagcctctggattcactctcggaaacttttggatggtctgggtccgccaggctccagggaaggggctgggagtgggtggccaatatacagtcaggtggaggtacgatacactatctcgactctgtgaagggccggttcaccatctccagagacaacgccaagaattcactgtatctgcaaatgaacagcctgagagtcgaagacacgggtatttattattgtgtgcgagatctggatttccttcgaaatgaagtgtggttcgatgtgtttg

SEQ ID NO: 455094 - DNA, 514 bp, Homo sapiens
  misc_feature: HEFZJCU01DC44N.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaacctggtcgccgtctcctcagcctccaccaagggccatcggtcttcccctggcaccctcctccaagagcacctctgggggcacagcggcctgggctgcctggtcaaggactacttccagacgtatca

SEQ ID NO: 455095 - DNA, 392 bp, Homo sapiens; identical to SEQ ID NO: 444682
  misc_feature: HEFZJCU01COP83.16.70.G04.1.454.heavy.3.raw

SEQ ID NO: 455096 - DNA, 528 bp, Homo sapiens
  misc_feature: HEFZJCU01EGG4I.12.40.D07.1.454.heavy.3.raw
  modified_base (510)..(510): a, c, t, g, unknown or other
atacgacgtacacgaccggtgctcgatttagtgatagagcgtaacaacagaggactcaccatggagtttgggctgagcgtgggttttccgtcgttagctcttttaagaggtgcccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccagggggaccctggtcatcgtctccccagcctccaccaagggcccanccggtcttccccctggcg

SEQ ID NO: 455097 - DNA, 530 bp, Homo sapiens
  misc_feature: HEFZJCU01DR7QJ.7.78.H01.1.454.heavy.3.raw
cgtgtctctacacgaccggtgctcgatttagtgtgagtagtttgggtttggggacccaacaaccacaccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaaggg

SEQ ID NO: 455098 - DNA, 526 bp, Homo sapiens; identical to SEQ ID NO: 450425
  misc_feature: HEFZJCU01CK0FV.9.78.H01.1.454.heavy.3.raw

SEQ ID NO: 455099 - DNA, 533 bp, Homo sapiens
  misc_feature: HEFZJCU01AK4PA.8.25.C03.1.454.heavy.3.raw
ctcgcgtgtccacgaccggtgctcgatttagtagtgtagatttgggtttgggtgccgaagttgctggaggtcacggtcaccacgctgctgagggagtagagtcctgaggcttggtacagccagggcggtccctgagactctcctgtacagggactggattcatctttggtgactatgctgtgacctgggtccgccaggctccagggaaggggctgggagtgggtaagtctcattagaagtaaagcttatggtgggacaacagattacgccgcgtctgtgaaaggcagattcaccatctcaagagatgattccaaaagcatcgcctttctacaaatggacagcctgaaaaccgaggacacaggcgtgtattactgcaacaggtttggttcgggaatccgcaaaatgacctctgggccagggaaccctggtcaccgtctcctcagcctccaccaagggcccatcggtccttccccctcggcgccctcgctccaggagcacctccgagagcacagccggcccgtcgggctgccttc

SEQ ID NO: 455100 - DNA, 501 bp, Homo sapiens
  misc_feature: HEFZJCU01AP7FW.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggccctgggctgcctggtcaaggactactcccacta

SEQ ID NO: 455101 - DNA, 379 bp, Homo sapiens; identical to SEQ ID NO: 444450
  misc_feature: HEFZJCU01ES4NT.47.77.G11.1.454.heavy.3.raw

SEQ ID NO: 455102 - DNA, 525 bp, Homo sapiens; identical to SEQ ID NO: 450208
  misc_feature: HEFZJCU01CYAEA.3.82.H05.1.454.heavy.3.raw

SEQ ID NO: 455103 - DNA, 492 bp, Homo sapiens; identical to SEQ ID NO: 444695
  misc_feature: HEFZJCU01CTS9Q.3.34.D01.1.454.heavy.3.raw

SEQ ID NO: 455104 - DNA, 520 bp, Homo sapiens
  misc_feature: HEFZJCU01AKCDH.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggacccg

SEQ ID NO: 455105 - DNA, 484 bp, Homo sapiens
  misc_feature: HEFZJCU01AHQ5L.51.67.G01.1.454.heavy.3.raw
cgatcgtatacacgaccggtgctcgatttagagtatacatattgggtttgggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggtagttatatcatatgatggaagcaagatatactatgtagactccgtgaagggccgattcatcatctccagagacaactccgagaacacgctgtatctgcaaatgaacaggctgagagctgaagacacggctgtatattactgtgcgaactt

SEQ ID NO: 455106 - DNA, 501 bp, Homo sapiens
  misc_feature: HEFZJCU01EL6A9.48.34.D01.1.454.heavy.3.raw
agtatacatacacgaccggtgctcgatttagatcgtctgtgttggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcggggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 455107 - DNA, 525 bp, Homo sapiens
  misc_feature: HEFZJCU01B68O1.49.56.F01.1.454.heavy.3.raw
agtcgagagacacgaccggtgctcgatttagcagacgtctgaacacacaaagggggggagaggagccccagcccggagattcccaggtgtttccattcggtgatcagcactgaacacagagaactcaccatggagtttggactgagctgggttttccttgttgccatgttaaaaggtgtccagtgtgaagtgcggctggtggagtctgggggaggcgtggtgcagcctggggggtccctcagactctcctgtgcagcctccaacttcagctttggtgattttaccatgcactgggtccgccaaggtccggggcggggtctggagtgggtcgctcttattagtggagatgaagatggcacctactatgcagattctgtgaagggccggttcaccatctccagagacaacaggaaaagtccctagtatctgcaaatgaacagtctgaggactgaggacaccgccttgtattattgtgtaaaggaaatacaaagagtcttacgatgtttggagtgcatattacgtacg

SEQ ID NO: 455108 - DNA, 497 bp, Homo sapiens
  misc_feature: HEFZJCU01A43T0.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtctcccctggcgcctgct

SEQ ID NO: 455109 - DNA, 518 bp, Homo sapiens
  misc_feature: HEFZJCU01DQF0M.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccattcaccatctccagagacaattccaggaacacaatgtatttggaatgaacagcctaagtcctgaggacacgggtgtatactactgtacgaagggaggggggaaccagcgggagttccaagtactcctttgacgtcgtgggccgtac

SEQ ID NO: 455110 - DNA, 518 bp, Homo sapiens
  misc_feature: HEFZJCU01CWZEO.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactgggccagggaaccctggtcaccgtctcctcagcctccaccaagggcccatcggtcttcccctcggcaccctcctccaagagcacctctgggggcacagcggccctgggctgcctggtcaggactacttcctagagacacg

SEQ ID NO: 455111 - DNA, 488 bp, Homo sapiens
  misc_feature: HEFZJCU01DMLWJ.52.19.B08.1.454.heavy.3.raw
cgcagtacgacacgaccggtgctcgatttagtgagtcagtaagggggggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatctgcaaatgatcaggctgagagctgaagacacggctttatattactgtgcgaacttaatcacggaggacaac

SEQ ID NO: 455112 - DNA, 513 bp, Homo sapiens; identical to SEQ ID NO: 446452
  misc_feature: HEFZJCU01A4IG1.17.33.C11.1.454.heavy.3.raw

SEQ ID NO: 455113 - DNA, 518 bp, Homo sapiens
  misc_feature: HEFZJCU01CK63V.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatggggtggcagttatatggtttgatggaactaacaaattctataagcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctcgtggggcacagcggcccg

SEQ ID NO: 455114 - DNA, 489 bp, Homo sapiens
  misc_feature: HEFZJCU01BBVHL.11.13.B02.1.454.heavy.3.raw
  modified_base (315)..(315): a, c, t, g, unknown or other
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactntgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaggactacttcgtatctctcg

SEQ ID NO: 455115 - DNA, 509 bp, Homo sapiens; identical to SEQ ID NO: 444586
  misc_feature: HEFZJCU01DT2L3.12.78.H01.1.454.heavy.3.raw

SEQ ID NO: 455116 - DNA, 519 bp, Homo sapiens; identical to SEQ ID NO: 444867
  misc_feature: HEFZJCU01CWATA.9.34.D01.1.454.heavy.3.raw

SEQ ID NO: 455117 - DNA, 512 bp, Homo sapiens
  misc_feature: HEFZJCU01EB9RN.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggccatatattactgtgcgagagattggggccgacggaaaccttgactactggggccagggaaccctggtcaccgt

SEQ ID NO: 455118 - DNA, 533 bp, Homo sapiens
  misc_feature: HEFZJCU01CCYEY.48.76.G10.1.454.heavy.3.raw
agtatacatacacgaccggtgctcgatttagtcactcatacagggggggagaggagccccagccgtgagattcccaggagttttcacttggtgatcagccctgaaaacagaccaccaaccatggagtttgggcttaactgggttttccttgttgctattttaaaaggtgcccaatgtgaggtgcagctggtggagtctgggggagccttggtacagccaggggggtccctgagactctcctgttcaacttctggattcacctttggtgattatattatgagttgggtccgccaggcgccagggaaggcactggagtgggttgctttcattagtcccaaactttctggtgggacagcatactacgccccgccagaatatgccgcgtctgtgcaaggcagattcaccatgtcaagagatgaatccaaaggtatcgcctatctgcaaatgaacagcctagaaaacccgaggacacagccgtctattactgtactagagccttattttgtacatctggtgtattcaccctttcccgt

SEQ ID NO: 455119 - DNA, 514 bp, Homo sapiens
  misc_feature: HEFZJCU01BKL95.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaaggcccatcggtcttcccctggcaccctcctccaagagcacctctgggggcacagcggccctgggctgcctgtcaaggactacttccagacgtat

SEQ ID NO: 455120 - DNA, 403 bp, Homo sapiens; identical to SEQ ID NO: 444540
  misc_feature: HEFZJCU01BQ7IQ.16.72.G06.1.454.heavy.3.raw

SEQ ID NO: 455121 - DNA, 422 bp, Homo sapiens; identical to SEQ ID NO: 454037
  misc_feature: HEFZJCU01B5I97.40.70.G04.1.454.heavy.3.raw

SEQ ID NO: 455122 - DNA, 487 bp, Homo sapiens
  misc_feature: HEFZJCU01CIM96.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaaggccatcggtcttcccctggcgccctgctccaggagcacctccgagagcacagcggccctgggctgcctggtcaaggactacttcctacgtgagct

SEQ ID NO: 455123 - DNA, 506 bp, Homo sapiens; identical to SEQ ID NO: 445682
  misc_feature: HEFZJCU01CQJNH.48.44.D11.1.454.heavy.3.raw

SEQ ID NO: 455124 - DNA, 535 bp, Homo sapiens
  misc_feature: HEFZJCU01ELVX7.52.53.E09.1.454.heavy.3.raw
cgcagtacgacacgaccggtgctcgatttagagagagtgtgttgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagcccgtaacttctggggccagggaacccgggtcaccgtctcctcagcctccaccaagggcccatccggtcttcccctcggccaccctccctccaagagcacctctgggggcacagcggccctgggctgcctggtcaaggacta

SEQ ID NO: 455125 - DNA, 511 bp, Homo sapiens
  misc_feature: HEFZJCU01BH0LL.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtctttttgattgccttttgatatggtggggccgaagggacaagtggtcaccgtt

SEQ ID NO: 455126 - DNA, 519 bp, Homo sapiens
  misc_feature: HEFZJCU01EZXAI.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttcccctggcaccctcctccaagagcacctctgggggcacac

SEQ ID NO: 455127 - DNA, 506 bp, Homo sapiens
  misc_feature: HEFZJCU01BG11V.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcaggcggcctttgaccttcgtc

SEQ ID NO: 455128 - DNA, 483 bp, Homo sapiens; identical to SEQ ID NO: 444639
  misc_feature: HEFZJCU01BJLZ2.11.23.C01.1.454.heavy.3.raw

SEQ ID NO: 455129 - DNA, 510 bp, Homo sapiens
  misc_feature: HEFZJCU01BRXY6.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactggggcccgggagcccctggt

SEQ ID NO: 455130 - DNA, 530 bp, Homo sapiens
  misc_feature: HEFZJCU01C31VL.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactgggccagggaaccctggtcaccgtctcctcagcctccaccaaggg

SEQ ID NO: 455131 - DNA, 503 bp, Homo sapiens
  misc_feature: HEFZJCU01DZ88Q.40.81.H04.1.454.heavy.3.raw
  modified_base (465)..(465): a, c, t, g, unknown or other
  modified_base (494)..(494): a, c, t, g, unknown or other
tctagcgactcacgaccggtgctcgatttagtagtgtagattcgcgggggagcatcacccagcaaccacatctgtccctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactggacctacgtgacgactacggccatgtatactgtgaagngacgttggtggctccgcggggctgaaccncgtgggccg

SEQ ID NO: 455132 - DNA, 499 bp, Homo sapiens
  misc_feature: HEFZJCU01DZK53.52.85.H08.1.454.heavy.3.raw
cgcagtacgacacgaccggtgctcgatttagtatcactcagtcgcggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctgatgcctccatcagtcgtgacgattactactggagctggatccgccagcccccagggaagggcctggaatggattggctacatcttttacagtgagagcacctcctacaacccgtccctcaagagtcgagttaccatatcagctgacaagtccaagaaccacttctccctgaagctgacctctgtgactgccacagacacggccgtctattactgtgccagagggatcgctagaggtggctccatcgttttagactcctgggccagggaaccctggtctccgt

SEQ ID NO: 455133 - DNA, 403 bp, Homo sapiens
  misc_feature: HEFZJCU01D635R.16.72.G06.1.454.heavy.3.raw
tgtactactccacgaccggtgctcgatttagctacgactgcaagggaaaggggctggagtgggtctcatctattagtagtagtgatagtgacacatactacgcagactccgtgaagggccggttcaccatctccagagatagatccaagaacacgctgtatctgcaaatggacagcctgagagccgaggacacggccatatattactgtgcgaaagatctggggaatgactacgatggtaccaacgtccgcttggactcctggggccagggagccctggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 455134 - DNA, 527 bp, Homo sapiens
  misc_feature: HEFZJCU01CIPEB.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgcatctgacgacacggccatatattactgtgcgagaaggacggtttttgggggcgcggactcctcttgagatcctgggggccagggggacaagtggtcaccggtctcttcagt

SEQ ID NO: 455135 - DNA, 463 bp, Homo sapiens; identical to SEQ ID NO: 446208
  misc_feature: HEFZJCU01DCZ58.19.10.A10.1.454.heavy.3.raw

SEQ ID NO: 455136 - DNA, 499 bp, Homo sapiens
  misc_feature: HEFZJCU01DQITT.52.85.H08.1.454.heavy.3.raw
cgcagtacgacacgaccggtgctcgatttagtatcactcagtcgcggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctgatgcctccatcagtcgtgacgattactactggagctggatccgccagcccccagggaagggcctggaatggattggctacatcttttacagtgagagcacctcctacaacccgtccctcaagagtcgagttaccatatcagctgacaagtccaagaaccacttctccctgaagctgacctctgtgactgcccacagacacggccgtctattactgtgccagagggatcgctagaggtggctccattcgtttagactctgggccagggaaccctggtctccgt

SEQ ID NO: 455137 - DNA, 399 bp, Homo sapiens
  misc_feature: HEFZJCU01EBRCQ.11.70.G04.1.454.heavy.3.raw
cgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtcttccccctggcaccctcctccaagagcacctctggggcacagcgccctgggctgcctggtcaaggactacttcgtatctctcg

SEQ ID NO: 455138 - DNA, 500 bp, Homo sapiens
  misc_feature: HEFZJCU01BKQ3F.14.55.E11.1.454.heavy.3.raw
cgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtggtgatcca

SEQ ID NO: 455139 - DNA, 515 bp, Homo sapiens
  misc_feature: HEFZJCU01BXZJE.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtgcagttgttcatctgagggcagtgttcaatggtatgcagactccgtgaagggccgattcaccatctccagagacaattccaggaacacaatgtatttggaatgaacagcctaagtcctgaggacacgggtgtatactactgtacgaagggagggggaaccaggcgggagttccaagtacttcc

SEQ ID NO: 455140 - DNA, 496 bp, Homo sapiens
  misc_feature: HEFZJCU01CHAKY.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcacctctgggggcacgagcggccctgggctgcctggtcaggactacttctacgtcgtat

SEQ ID NO: 455141 - DNA, 504 bp, Homo sapiens
  misc_feature: HEFZJCU01E0PSQ.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacggcagcggcctttgacttctc

SEQ ID NO: 455142 - DNA, 501 bp, Homo sapiens
  misc_feature: HEFZJCU01DXXI5.10.35.D02.1.454.heavy.3.raw
catagtagtgcacgaccggtgctcgatttagcacacgatagttgggtttgggggaggcttggttaagccgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccagagcacctccgagagcacagcggccctgggctgcctggtcaaggactactcccactactatg

SEQ ID NO: 455143 - DNA, 507 bp, Homo sapiens
  misc_feature: HEFZJCU01CSDUJ.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaaagtgacgtggtattccggggggacacatgactaccg

SEQ ID NO: 455144 - DNA, 511 bp, Homo sapiens
  misc_feature: HEFZJCU01CJU79.10.53.E09.1.454.heavy.3.raw
catagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggagcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgttctgcaaatgaacagcctgagagctgagacacggctgtgtattactgttcgtttggttctgactcgtcgggggataccttcagcactgggccac

SEQ ID NO: 455145 - DNA, 509 bp, Homo sapiens
  misc_feature: HEFZJCU01A5U5Y.52.67.G01.1.454.heavy.3.raw
cgcagtacgacacgaccggtgctcgatttagagtatacatattgggtttggggacccaacaaccacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccagggcagagtcaccatcaccagggacacatccgcgagcacagcctacatggagttgagcagcctgagaaatgaagacacggctgtatattactgtgcgagaggggaaatggcctccaccaagggcccatcggtcttcccctcggcaccctcctcc

SEQ ID NO: 455146 - DNA, 509 bp, Homo sapiens; identical to SEQ ID NO: 445157
  misc_feature: HEFZJCU01D7A9X.4.67.G01.1.454.heavy.3.raw

SEQ ID NO: 455147 - DNA, 503 bp, Homo sapiens
  misc_feature: HEFZJCU01DPDPG.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatgggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccg

SEQ ID NO: 455148 - DNA, 511 bp, Homo sapiens; identical to SEQ ID NO: 445268
  misc_feature: HEFZJCU01DEYFK.48.34.D01.1.454.heavy.3.raw

SEQ ID NO: 455149 - DNA, 379 bp, Homo sapiens; identical to SEQ ID NO: 444450
  misc_feature: HEFZJCU01CHS53.47.77.G11.1.454.heavy.3.raw

SEQ ID NO: 455150 - DNA, 396 bp, Homo sapiens; identical to SEQ ID NO: 444469
  misc_feature: HEFZJCU01BR77Z.47.46.E02.1.454.heavy.3.raw

SEQ ID NO: 455151 - DNA, 522 bp, Homo sapiens
  misc_feature: HEFZJCU01BQSFX.53.57.F02.1.454.heavy.3.raw
  modified_base (459)..(459): a, c, t, g, unknown or other
cgcgtatacacacgaccggtgctcgatttagctcgatatagttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatatcaaatgatggaagtaagaaatactatgtagactccgtgaaggccgattcaccatctccagagacaattccaagaatacgctgtatctgcacatgaacagcctgagagccgaagacacgggtntttattactgtgcgaacttaattacggaggacaacggtaaccccgtccgcacggtacggaccg

SEQ ID NO: 455152 - DNA, 503 bp, Homo sapiens
  misc_feature: HEFZJCU01EOCAS.10.12.B01.1.454.heavy.3.raw
catagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaaggggctggaatggatgacagttatttcacacgatgcaaccaaaacatactacgcggagttcgtgaggggccgctgcatcgtctccagagacaattcgaagaacactctgtacctgcaaatgaacagtctgagagccgaggacacggccgtctactttgtgcgactagaagtgggagctataggggattt

SEQ ID NO: 455153 - DNA, 394 bp, Homo sapiens; identical to SEQ ID NO: 444701
  misc_feature: HEFZJCU01EQ0CN.3.12.B01.1.454.heavy.3.raw

SEQ ID NO: 455154 - DNA, 400 bp, Homo sapiens
  misc_feature: HEFZJCU01BDKVD.53.42.D09.1.454.heavy.3.raw
cgcgtatacacacgaccggtgctcgatttagacacatacgcagggaaaggggctgttgtgggtctcacgtattaatggagatgggagcagcacacacaacgcggactccgtgaagggccgattcatcatctccagagacaacgtcaagaatatactatatctgcagatgaatggtctgagggccgacgactcggctggtgttctactgtgcaagaggcggcagtggctacagtgcctactactacggtctggacgtctggggccaggggaccactgtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 455155 - DNA, 500 bp, Homo sapiens
  misc_feature: HEFZJCU01A6VJV.12.55.E11.1.454.heavy.3.raw
atacgacgtacacgaccggtgctcgatttagcactcgcacgttgggtttgggctgagcgtggtttcgtcgtaggctctttaagtaggtgtccagtgtcagatgcagctggtggagtctgggggaggcgtggtccggcctgggacgtccctgacactctcctgtgcagccgctggattcaccttacccagttatgctatgcactgggtccgccaggctccaggggaaggggctggaatgggtggcagttatatcatatgatggaagctatcaatattacgcagattctgtgaagggccactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccagggcccatcggtcttcccctggcgccctgctcc

SEQ ID NO: 455156 - DNA, 397 bp, Homo sapiens
  misc_feature: HEFZJCU01CXX8T.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgagggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 455157 - DNA, 484 bp, Homo sapiens; identical to SEQ ID NO: 452423
  misc_feature: HEFZJCU01EOCEA.47.59.F04.1.454.heavy.3.raw

SEQ ID NO: 455158 - DNA, 523 bp, Homo sapiens
  misc_feature: HEFZJCU01C3SD1.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctgggccggggaaccctggtcaccgtctccccaccctccaccaagggcccatcggtcttcccctggcaccctcctccagagcacctctgggggcacagcggccctgggctgcctggtcaaggactacttcccatactcgta

SEQ ID NO: 455159 - DNA, 392 bp, Homo sapiens; identical to SEQ ID NO: 444682
  misc_feature: HEFZJCU01CP17C.16.70.G04.1.454.heavy.3.raw

SEQ ID NO: 455160 - DNA, 500 bp, Homo sapiens; identical to SEQ ID NO: 445028
  misc_feature: HEFZJCU01ARIFB.13.12.B01.1.454.heavy.3.raw

SEQ ID NO: 455161 - DNA, 527 bp, Homo sapiens
  misc_feature: HEFZJCU01CURKD.48.28.C06.1.454.heavy.3.raw
agtatacatacacgaccggtgctcgatttagagctcacgtattgggtttgggggtgactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgtacacacaccatcttgacgacgtggggatgcttttctatttctggggccaggggaccgtggtcgccgtgtctacagcctccaccaagggcccatcggtcttcccctgg

SEQ ID NO: 455162 - DNA, 392 bp, Homo sapiens; identical to SEQ ID NO: 444456
  misc_feature: HEFZJCU01EDV6U.7.60.F05.1.454.heavy.3.raw

SEQ ID NO: 455163 - DNA, 391 bp, Homo sapiens; identical to SEQ ID NO: 446378
  misc_feature: HEFZJCU01A73UC.16.24.C02.1.454.heavy.3.raw

SEQ ID NO: 455164 - DNA, 541 bp, Homo sapiens
  misc_feature: HEFZJCU01BPLGQ.5.86.H09.1.454.heavy.3.raw
atcagacacgcacgaccggtgctcgatttagtgctatagacttgggtttgggggctctgagagaggagcccagccctgggattttcaggtgttttcatttggtgatcaggactgaacagagagaactcaccatggagtttgggctgagcgtggcgttttcttaggtggctattttaaaaggtgtccagtgtgaggtacagctgttggagtctgggggaggcttggtacagcctggggggtccctgagactctcctgtgcagcctctggattcacctttactgattttggcatgacgtgggtccgccaggctccagggaaggggctggactggctctcaaatattaatggtaaaggcaatatacaagactacacagactccgtgaagggccggttcaccacctcgagagacaactccagggacacggtgtacctacacatgaacagcctgagagccgaggacacggccgtatattattgtgtgaggggaaacgtgggggcaatttgaccgcgtggggccagggaaccctggtcaccgtctcc

SEQ ID NO: 455165 - DNA, 483 bp, Homo sapiens; identical to SEQ ID NO: 444924
  misc_feature: HEFZJCU01CP907.10.35.D02.1.454.heavy.3.raw

SEQ ID NO: 455166 - DNA, 507 bp, Homo sapiens; identical to SEQ ID NO: 448429
  misc_feature: HEFZJCU01EKEMZ.3.17.B06.1.454.heavy.3.raw

SEQ ID NO: 455167 - DNA, 499 bp, Homo sapiens; identical to SEQ ID NO: 453198
  misc_feature: HEFZJCU01D37F3.11.71.G05.1.454.heavy.3.raw

SEQ ID NO: 455168 - DNA, 453 bp, Homo sapiens
  misc_feature: HEFZJCU01BVGWS.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggaatgggtctcagttattgaaaatgatggtgacacaatctacgccgactccgtgaagggccgattcaccatctccagagacaattccaagaacacggtgaatcttcaaatgaacagcctgagaaccgaggacacggccgtatattattgtataggttatggtggtaattcgggcccctggggccagggaaccgtggtcaccgtctcctcagcctccaccaagggcccatcggtcttccccctggcgccctgctccaggagcacctccgagagcacagcggccctgggctgcctggtcaaggactacttccgagtagtaca

SEQ ID NO: 455169 - DNA, 519 bp, Homo sapiens; identical to SEQ ID NO: 446650
  misc_feature: HEFZJCU01BVI68.13.76.G10.1.454.heavy.3.raw

SEQ ID NO: 455170 - DNA, 506 bp, Homo sapiens
  misc_feature: HEFZJCU01E10Z5.53.53.E09.1.454.heavy.3.raw
cgcgtatacacacgaccggtgctcgatttagagagagtgtgttgggtttggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccaagaacacactgtttcttcaaatggacttcctgagaactgaggacacggccgtgtattactgcgcgagagtgcatgatagtggtttccatgatgcttttgat

SEQ ID NO: 455171 - DNA, 525 bp, Homo sapiens
  misc_feature: HEFZJCU01EG7MP.19.67.G01.1.454.heavy.3.raw
  modified_base (377)..(377): a, c, t, g, unknown or other
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgccaggctccagggaagaggccggagtgggtcgcaggtatttttataggtgggacgacattctacggagactccatggagggccgattcaccatctccagagacttttcncagaacacactgtctcttcaaatgaacagcctgagggccgaggacacggccgtctattattgtgtgagtagtttatggcgatgggctgggtggacagatcacgtggggccagggaaccctggtcaccgtctcctcagcctccaccaac

SEQ ID NO: 455172 - DNA, 520 bp, Homo sapiens
  misc_feature: HEFZJCU01BY5PY.9.34.D01.1.454.heavy.3.raw
tgatacgtctcacgaccggtgctcgatttagatcgtctgtgttggggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttccccctggccaccctcctccaagagcacctctgggggcacagcggccctgggctgcctggtcaaggactacttccagacgtatca

SEQ ID NO: 455173 - DNA, 503 bp, Homo sapiens
  misc_feature: HEFZJCU01A096T.40.65.F10.1.454.heavy.3.raw
tctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgccttgatatgtgggccaagggacaatggtcaccgtctcttcagctccaccaaggcccatcc

SEQ ID NO: 455174 - DNA, 491 bp, Homo sapiens
  misc_feature: HEFZJCU01BYWTY.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagcggtggtttcgcgtaggcgtctttaagtaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgcacgtctctctactactgtgcgagagagttgacgagt

SEQ ID NO: 455175 - DNA, 497 bp, Homo sapiens
  misc_feature: HEFZJCU01CH6QL.40.81.H04.1.454.heavy.3.raw
tctagcgactcacgaccggtgctcgatttagtagtgtagattcgcgggggcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctgggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgcgacacggccatgtattactgtggaagagacgttggtggctaccgcggggctgaccatggggccaac

SEQ ID NO: 455176 - DNA, 491 bp, Homo sapiens; identical to SEQ ID NO: 450266
  misc_feature: HEFZJCU01BHUFG.53.26.C04.1.454.heavy.3.raw

SEQ ID NO: 455177 - DNA, 537 bp, Homo sapiens
  misc_feature: HEFZJCU01D961V.53.68.G02.1.454.heavy.3.raw
cgcgtatacacacgaccggtgctcgatttagtcgatagtgaagggaaaggggcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgccaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggttttggactggttctcccatggaatccctactttgagtactgggccgcggagccctggtcaccgtctcctcagcctccaccaagggcccatcggtcttcccctggccaccct

SEQ ID NO: 455178 - DNA, 495 bp, Homo sapiens; identical to SEQ ID NO: 446556
  misc_feature: HEFZJCU01EW33S.10.71.G05.1.454.heavy.3.raw

SEQ ID NO: 455179 - DNA, 489 bp, Homo sapiens
  misc_feature: HEFZJCU01DWXTQ.53.56.F01.1.454.heavy.3.raw
  modified_base (460)..(460): a, c, t, g, unknown or other
cgcgtatacacacgaccggtgctcgatttagcagacgtctgaacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcgagggcgagggtcaccatgaccgagggacaccggtccatcagcacagcctacatggagctacacggcctgagatctgacgacacggccctgtnttttgtgcgagagagtctattaaagtggc

SEQ ID NO: 455180 - DNA, 526 bp, Homo sapiens; identical to SEQ ID NO: 445530
  misc_feature: HEFZJCU01C41TC.12.86.H09.1.454.heavy.3.raw

SEQ ID NO: 455181 - DNA, 488 bp, Homo sapiens
  misc_feature: HEFZJCU01BYHFG.12.53.E09.1.454.heavy.3.raw
atacgacgtacacgaccggtgctcgatttagagagagtgtgttgggtttggggggtccctgagactctcctgtgcagcctctcgattcagcttcagtaactatgctatgcactgggtctgccaggctccaggcagggggctggagtgggtggcagttatatcatatgatggaagacataaatactacgcagactccgtgaagggccgattcaccctctccagagacaattccaagaatacgctgtatatgcaaatgaacagcctgagacctgaggacacggctatgtattactgtgcgagaggaccattttggaatgcttattataccggaaacgcttttgatatttggggccaagggacaatggtcaccgtctcttcagcctccaccaagggcccatcggtcttcccctggcaccctcctccaagagcacctctgggggcacagcggccctgggctgcctggtcaaggactacttcctacgtcgtat

SEQ ID NO: 455182 - DNA, 336 bp, Homo sapiens; identical to SEQ ID NO: 444510
  misc_feature: HEFZJCU01EXJZ6.3.31.C09.1.454.heavy.3.raw

SEQ ID NO: 455183 - DNA, 399 bp, Homo sapiens; identical to SEQ ID NO: 444863
  misc_feature: HEFZJCU01AE75V.4.77.G11.1.454.heavy.3.raw

SEQ ID NO: 455184 - DNA, 452 bp, Homo sapiens
  misc_feature: HEFZJCU01CCQ4X.8.10.A10.1.454.heavy.3.raw
ctcgcgtgtccacgaccggtgctcgatttagcgtcgatctcaggggtccgggagatcatgagggtgtccttgggttttggggggaagaggaagactgacggtccccccaggagttcaggtgcccactcccaggttcagctggtgcagtctggagctgagaagttccagggcagagtctccatgaccatagacacatccgcgaccacagcctatatggagttgacgagcctgagatctgacgacacggccgtgtattactgtgcgagggatgtagtagtgacgtggtacgccggggggaaacttgactactggggccagggatccctggtcaccgtctcctcagcctccaccaagggcccatcggtcttccccctggcaccctcctccaagagcacctctgggggcacagcggccctgggctgcctggtcaaggactacttccgacacgcgag

SEQ ID NO: 455185 - DNA, 516 bp, Homo sapiens
  misc_feature: HEFZJCU01BXRA9.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaaccgttactacgctatggacgtcgtggggaccg

SEQ ID NO: 455186 - DNA, 518 bp, Homo sapiens; identical to SEQ ID NO: 451751
  misc_feature: HEFZJCU01C9SR3.9.34.D01.1.454.heavy.3.raw

SEQ ID NO: 455187 - DNA, 526 bp, Homo sapiens
  misc_feature: HEFZJCU01CJ01Y.48.55.E11.1.454.heavy.3.raw
agtatacatacacgaccggtgctcgatttagcactcgcacgttgggtttgggggactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgtacacacaccatcttgacgactggggatgcttttcatttctggggccaggggaccgtggtcgccgtgtctacagcctccaccaagggcccatcggtcttcccctggcta

SEQ ID NO: 455188 - DNA, 498 bp, Homo sapiens
  misc_feature: HEFZJCU01CVLXT.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggctttcccctggcgcctgct

SEQ ID NO: 455189 - DNA, 504 bp, Homo sapiens; identical to SEQ ID NO: 445222
  misc_feature: HEFZJCU01DEFEJ.9.33.C11.1.454.heavy.3.raw

SEQ ID NO: 455190 - DNA, 522 bp, Homo sapiens
  misc_feature: HEFZJCU01BV5K1.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtgggccggggaacctggtcaccgtctcttcagcctccaccaagggcccatcggtcttcccctcggccaccctcctccaagacgcacctctggggggcacacgcc

SEQ ID NO: 455191 - DNA, 514 bp, Homo sapiens
  misc_feature: HEFZJCU01BC30C.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactgggggcccgggagcccctgggtcc

SEQ ID NO: 455192 - DNA, 488 bp, Homo sapiens
  misc_feature: HEFZJCU01AJ9UX.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctggtcaggactacttcctacgtgagct

SEQ ID NO: 455193 - DNA, 524 bp, Homo sapiens; identical to SEQ ID NO: 445728
  misc_feature: HEFZJCU01EOHNK.5.33.C11.1.454.heavy.3.raw

SEQ ID NO: 455194 - DNA, 385 bp, Homo sapiens; identical to SEQ ID NO: 444438
  misc_feature: HEFZJCU01ELWCO.18.60.F05.1.454.heavy.3.raw

SEQ ID NO: 455195 - DNA, 472 bp, Homo sapiens; identical to SEQ ID NO: 445355
  misc_feature: HEFZJCU01EQGP8.4.37.D04.1.454.heavy.3.raw

SEQ ID NO: 455196 - DNA, 496 bp, Homo sapiens
  misc_feature: HEFZJCU01EU9RP.40.37.D04.1.454.heavy.3.raw
tctagcgactcacgaccggtgctcgatttagtagcatactgttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccggggaatcctggtcaccgtctcctcagcctccaccaagggcccatcggtcttcccctggcgccctgctccaggagcacctccgagagcacagcggccctggctgcctggtcaaggactacttccagtcgctaga

SEQ ID NO: 455197 - DNA, 423 bp, Homo sapiens; identical to SEQ ID NO: 444772
  misc_feature: HEFZJCU01EKV4U.16.78.H01.1.454.heavy.3.raw

SEQ ID NO: 455198 - DNA, 389 bp, Homo sapiens
  misc_feature: HEFZJCU01BAJQP.52.53.E09.1.454.heavy.3.raw
cgcagtacgacacgaccggtgctcgatttagagagagtgtgttgggtttgggtctcatttatcagtgatactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttccccctggcaccctcctccaagagcacctctgggggcacagcggccctgggctgcctggtcaaggactacttcctatacgatcg

SEQ ID NO: 455199 - DNA, 518 bp, Homo sapiens
  misc_feature: HEFZJCU01BCBTQ.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttccccctggcaccctcctccaagagcacctctgggggcacagcggccctggctgcctggtcaaggactacttccgagtgctctcgtgaggcggcgtcgacgacggcgcatg

SEQ ID NO: 455200 - DNA, 510 bp, Homo sapiens
  misc_feature: HEFZJCU01CW4PR.49.62.F07.1.454.heavy.3.raw
agtcgagagacacgaccggtgctcgatttagtagtcgcataaagggaaagggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaagggggctggagtgggtggcacttatatcctatgatggaagcaataagcactacgcagagtccgtgaagggccgattgaccatctccagagacaactcgaagaatacggttcttctacaaatgaacagcctgagagctgaggacacggctatcttttactgttgcgagagggaactcgattacagcagccctacg

SEQ ID NO: 455201 - DNA, 500 bp, Homo sapiens; identical to SEQ ID NO: 447174
  misc_feature: HEFZJCU01CIK9K.7.76.G10.1.454.heavy.3.raw

SEQ ID NO: 455202 - DNA, 516 bp, Homo sapiens
  misc_feature: HEFZJCU01EBCCS.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctagaggacacgggtgtatactactgtacgaagggagggggaaccgagcgggagttcaagtactcctttgacgtcgtgggcc

SEQ ID NO: 455203 - DNA, 519 bp, Homo sapiens
  misc_feature: HEFZJCU01EC1E9.13.71.G05.1.454.heavy.3.raw
tcacgtactacacgaccggtgctcgatttagtgtcgtcgcaagagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggggcttggtccagcctggggggtccctgagactctcctgtgcagcctctggattcacttttagtaggtattggatgggttgggtccgccagactccagagaagggactggagtgggtggccaacataaaggaagatggaagtgaaaagatactatgtggactctgtgaagggccgattcaccatctccagagacaacgccaagaactcactgtatctgcagatgaccagcctgagagtcggaggatacggctgtgtattattgtgcgagagatgggggcacgactattttgtagagggtgtacgtgggggccaggggacgg

SEQ ID NO: 455204 - DNA, 518 bp, Homo sapiens
  misc_feature: HEFZJCU01DZQ88.9.34.D01.1.454.heavy.3.raw
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctcggcaccctcctccaagagcacctctgggggcacagcggccctggactgcctggtcaaggactactccagacgtatca

SEQ ID NO: 455205 - DNA, 476 bp, Homo sapiens; identical to SEQ ID NO: 444967
  misc_feature: HEFZJCU01BL3GD.16.10.A10.1.454.heavy.3.raw

SEQ ID NO: 455206 - DNA, 504 bp, Homo sapiens
  misc_feature: HEFZJCU01BN6AL.47.81.H04.1.454.heavy.3.raw
agctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttccttgttgctatattagaaggtgtccagtgtgaggtgcagctggtggagtcggggggaggcctggtacagcctggggggtccctgagactctcctgtgcagcctctggattcatcttcagtgactacgacatgcactgggtccgccaagttgcaggagaacctctggaatgggtctccgttattgctactggtggtgccacagactatgcaggctccgtgaggggccgattcaccatctccagagaaaatggcaagaactccttgtatcttcaaatgaacagcctgagagccggggacacggcggtgtattactgtgtaagagagctcgatggtaacaggggacttaat

SEQ ID NO: 455207 - DNA, 512 bp, Homo sapiens
  misc_feature: HEFZJCU01BBWIY.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttggaggacgacggctgtttattactgtacgaaagaggggggatacgagtggcagctaccaagtacttacg

SEQ ID NO: 455208 - DNA, 524 bp, Homo sapiens
  misc_feature: HEFZJCU01DR0CH.21.78.H01.1.454.heavy.3.raw
  modified_base (510)..(510): a, c, t, g, unknown or other
tcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccgggaacctggtcaccgtcncccacctccaccac

SEQ ID NO: 455209 - DNA, 503 bp, Homo sapiens
  misc_feature: HEFZJCU01CPJ7U.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtactaatttgataggctctatggactggacttcgtc

SEQ ID NO: 455210 - DNA, 480 bp, Homo sapiens; identical to SEQ ID NO: 446065
  misc_feature: HEFZJCU01AFYMM.15.38.D05.1.454.heavy.3.raw

SEQ ID NO: 455211 - DNA, 491 bp, Homo sapiens
  misc_feature: HEFZJCU01BNWP1.22.86.H09.1.454.heavy.3.raw
acatacgcgtcacgaccggtgctcgatttagtgctatagacttgagctctgggagaggagcccagcactagaagtcggcggtgtttccattcggtgatcagcactgaacacagaggactcaccatggagtttgggctgagcgtggtttcgtcgttaggctcttttaagtaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacgggcagtgtattactgtgcgagagatcgacatgaacg

SEQ ID NO: 455212 - DNA, 525 bp, Homo sapiens
  misc_feature: HEFZJCU01C7HL9.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtggacggggccgattcaccatctccagagacaattccaagaacacgctgtttcttcaatgaacagcctgagagccgatgacacggccgtgtattactgtgcgagagagtcggggcccacgaacgttacacgctagtggacgtcgtggggaccgaagggaccg

SEQ ID NO: 455213 - DNA, 495 bp, Homo sapiens
  misc_feature: HEFZJCU01CNMZB.51.38.D05.1.454.heavy.3.raw
  modified_base (471)..(471): a, c, t, g, unknown or other
cgatcgtatacacgaccggtgctcgatttagtatctgatagttgggtttggggtctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctctttttacngttgcgccaggaagcagtggctgg

SEQ ID NO: 455214 - DNA, 436 bp, Homo sapiens
  misc_feature: HEFZJCU01DVU7G.49.34.D01.1.454.heavy.3.raw
agtcgagagacacgaccggtgctcgatttagatcgtctgtgttgggtttgggtgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttatactgtgcgaacttaattacggaggacaacggtaacccccgtccgcacggtacggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 455215 - DNA, 531 bp, Homo sapiens
  misc_feature: HEFZJCU01AVGNZ.17.28.C06.1.454.heavy.3.raw
  modified_base (370)..(370): a, c, t, g, unknown or other
  modified_base (484)..(484): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggttgagtccgggggaggcctgggtccagcctggggggtccctgagactctcctgtgcagcctccggattccccttcagtagttattggatgacttgggtccgccagactccagggaagggctggagtgggtggccaacataaagcaagatggaactgccgagttttacgnggactctgtgaagggccgtttcaccatctcagagacaacgccaagaattcactgtatctacaactgaacagcctgagagtcgcagacacggccgtgtattactgtgcgagatgngaaaaagtatggctgtgtttatggggccaggggagcctggtctaccg

SEQ ID NO: 455216 - DNA, 464 bp, Homo sapiens; identical to SEQ ID NO: 445062
  misc_feature: HEFZJCU01CVVUX.19.10.A10.1.454.heavy.3.raw

SEQ ID NO: 455217 - DNA, 504 bp, Homo sapiens
  misc_feature: HEFZJCU01EE3W5.10.23.C01.1.454.heavy.3.raw
catagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcagctttgatgaatatgccatggactgggtccggcaagttccagggaagggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagagggagtcgagggtttctaac

SEQ ID NO: 455218 - DNA, 518 bp, Homo sapiens; identical to SEQ ID NO: 449255
  misc_feature: HEFZJCU01B18NA.3.17.B06.1.454.heavy.3.raw

SEQ ID NO: 455219 - DNA, 506 bp, Homo sapiens; identical to SEQ ID NO: 449588
  misc_feature: HEFZJCU01DSD6L.11.72.G06.1.454.heavy.3.raw

SEQ ID NO: 455220 - DNA, 528 bp, Homo sapiens
  misc_feature: HEFZJCU01D5MY3.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggcgccctcg

SEQ ID NO: 455221 - DNA, 499 bp, Homo sapiens; identical to SEQ ID NO: 446805
  misc_feature: HEFZJCU01A2RKW.3.20.B09.1.454.heavy.3.raw

SEQ ID NO: 455222 - DNA, 531 bp, Homo sapiens; identical to SEQ ID NO: 446857
  misc_feature: HEFZJCU01BXAJ8.7.78.H01.1.454.heavy.3.raw

SEQ ID NO: 455223 - DNA, 379 bp, Homo sapiens; identical to SEQ ID NO: 444450
  misc_feature: HEFZJCU01C2PCN.47.77.G11.1.454.heavy.3.raw

SEQ ID NO: 455224 - DNA, 517 bp, Homo sapiens; identical to SEQ ID NO: 446039
  misc_feature: HEFZJCU01AHRK6.9.70.G04.1.454.heavy.3.raw

SEQ ID NO: 455225 - DNA, 513 bp, Homo sapiens
  misc_feature: HEFZJCU01E1H0M.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctgggggcacgagcggcctgggctgcctggtcaaggactacttcccatacc

SEQ ID NO: 455226 - DNA, 380 bp, Homo sapiens
  misc_feature: HEFZJCU01CL0O8.17.10.A10.1.454.heavy.3.raw
cgtagactagcacgaccggtgctcgatttagcgtcgatctcagggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcgatcgtacaatttgataggctctatggactggacttctggggccaggggaccacggtgatcgtctcatcagcctccaccaagggcccatcggtcttccccctggcaccctcctccaagagcacctctgggggcacagcggccctgggctgcctggtcaaggactacttccctagtctacg

SEQ ID NO: 455227 - DNA, 396 bp, Homo sapiens; identical to SEQ ID NO: 444469
  misc_feature: HEFZJCU01CW2PN.47.46.E02.1.454.heavy.3.raw

SEQ ID NO: 455228 - DNA, 520 bp, Homo sapiens
  misc_feature: HEFZJCU01CF01Y.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggttttggggcgcggactcctcttgagatcgtggggccagggggacaatggtcaccgtctcttc

SEQ ID NO: 455229 - DNA, 517 bp, Homo sapiens; identical to SEQ ID NO: 446891
  misc_feature: HEFZJCU01CQZCE.17.33.C11.1.454.heavy.3.raw

SEQ ID NO: 455230 - DNA, 509 bp, Homo sapiens; identical to SEQ ID NO: 445824
  misc_feature: HEFZJCU01A6PPR.9.14.B03.1.454.heavy.3.raw

SEQ ID NO: 455231 - DNA, 513 bp, Homo sapiens
  misc_feature: HEFZJCU01EY40J.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactgggccagggaactctggtcaccgtctccgcagcctccaccaagggcccc

SEQ ID NO: 455232 - DNA, 494 bp, Homo sapiens
  misc_feature: HEFZJCU01EWK8Q.49.57.F02.1.454.heavy.3.raw
agtcgagagacacgaccggtgctcgatttagctcgatatagttgggtttggggcatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcggacaaatccacgaacacagcctacatggaactgcgcagcctaggatctgccgacacggccgtatatttctgtgcgagagagatgtctttctatgatagtactagtcatt

SEQ ID NO: 455233 - DNA, 483 bp, Homo sapiens
  misc_feature: HEFZJCU01C3VZB.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctcgtgggggcacagcggccctgggctgcctggtcaaggactacttcctagagacacg

SEQ ID NO: 455234 - DNA, 533 bp, Homo sapiens
  misc_feature: HEFZJCU01C6JK8.4.71.G05.1.454.heavy.3.raw
agcactgtagcacgaccggtgctcgatttagtgtcgtcgcaagagagagggggaagaccgatgggcccttggtggaggcgttggtgaagccggggggtcccggttacgactctcctgtgcagtctctggactcaacctcaaaatagcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctgggccaagggaccacagtcaccgtctcctcaacctccaccaaggcccatcggtcttcccctgcgccctgctccaggagcacctccgagagcacagcggccctgggctgcctggtcaaggactacttccctac

SEQ ID NO: 455235 - DNA, 520 bp, Homo sapiens
  misc_feature: HEFZJCU01B49WS.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtggggccaagggaccg

SEQ ID NO: 455236 - DNA, 521 bp, Homo sapiens
  misc_feature: HEFZJCU01ECM1S.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagagtggggcccacggaacgttactacgctatggacgtcgtggggccaagggacccg

SEQ ID NO: 455237 - DNA, 403 bp, Homo sapiens
  misc_feature: HEFZJCU01AJ5DL.51.52.E08.1.454.heavy.3.raw
cgatcgtatacacgaccggtgctcgatttagtcgagctctcagagagaaaggggggggctatttataaacccaaaaggacatggccatgcagcgggtagggacaatacagacagatatcagcctgaagtggagcctcagggcacaggtgggcacggacactgtccacctaagccaggggcagacccgagtgtccccgcagtagacctgagagcgctgggcccacagcctcccctcggtgccctgctacctcctcaggtcagccctggacatcccggatttccccaggcctggcgcctccaccaagggcccatcggtcttccccctggcaccctcctccaagagcacctctgggggcacagcggccctgggctgcctggtcaaggactacttcctcgtagcact

SEQ ID NO: 455238 - DNA, 483 bp, Homo sapiens; identical to SEQ ID NO: 447860
  misc_feature: HEFZJCU01D2FNU.11.23.C01.1.454.heavy.3.raw

SEQ ID NO: 455239 - DNA, 504 bp, Homo sapiens; identical to SEQ ID NO: 450595
  misc_feature: HEFZJCU01AO176.51.43.D10.1.454.heavy.3.raw

SEQ ID NO: 455240 - DNA, 508 bp, Homo sapiens; identical to SEQ ID NO: 448235
  misc_feature: HEFZJCU01C7BCD.22.86.H09.1.454.heavy.3.raw

SEQ ID NO: 455241 - DNA, 541 bp, Homo sapiens
  misc_feature: HEFZJCU01ENZAC.40.28.C06.1.454.heavy.3.raw
tctagcgactcacgaccggtgctcgatttagagctcacgtattgggtttggggggaagaggaagactgacggtcctgccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcgtcggtggcactcctaacataagatattcacagaagtttcagttcagagtcacctttagcagcgacacatccgcgacgacagtctacatggagttgagtggcctaagatctgaagacacggctgtctattactgtgcgagagatgccttacacgacgagggggcccactttgattactggggccagggaacccgtggtcaccgtctcctcagcctccaccgaacgggcccacgtccggttccttcccccgtcgggccgcccgtcgtcctccgacgggacgccacccgtccgaac

SEQ ID NO: 455242 - DNA, 501 bp, Homo sapiens
  misc_feature: HEFZJCU01AIDEH.12.79.H02.1.454.heavy.3.raw
  modified_base (491)..(491): a, c, t, g, unknown or other
  modified_base (498)..(498): a, c, t, g, unknown or other
atacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaatctcctgcaagtcttctggttacgcactcaccgccaatggtatcagctggctgcgacaggcccctggacaaggtcttgagtggatgtcatggatcagcactttcaatggagacacaaagtatggagagaacttccagggcagagtcaccatgaccactgacagatcaacgaacatagcctacttggaactgaggggcctgaggtctgacgacacggccctctattattgtgcgagaattaattttcgttattgttctggtggtgtgtgttnatgtttnacc

SEQ ID NO: 455243 - DNA, 497 bp, Homo sapiens
  misc_feature: HEFZJCU01EHPGW.4.26.C04.1.454.heavy.3.raw
agcactgtagcacgaccggtgctcgatttagtctagcgactttgggtttggggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatctccagagacaattccaagaacacgttatatctgcaaatgaacagcctgcgagccgacgacacggccgtatattactgtgcgaaatgccttattgcgaccgagcgtagcagtggctggtgcaactggctcgaccctggggccagggaacccatgtcaccgtctcctcagcctccaccaagggcccatcggtcttccccctggcgccctgctccaggagcacctccgagaacacagcggccctgggctgcctggtcaaggactacttccctacagtgct

SEQ ID NO: 455244 - DNA, 400 bp, Homo sapiens; identical to SEQ ID NO: 444452
  misc_feature: HEFZJCU01CRLOQ.47.24.C02.1.454.heavy.3.raw

SEQ ID NO: 455245 - DNA, 514 bp, Homo sapiens
  misc_feature: HEFZJCU01ECTFW.47.56.F01.1.454.heavy.3.raw
agctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgctattttaaaaggtgtccagtgtgaggtgcaactggtggagtccgggggaggcttaattcagcctggggggtccctgagactctcctgtgcagcctctggattcaccttcagtagttactggatgcactgggtccgccaagctccagggaaggactggtgtgggtctcacgtattaatcctgatggaagtcgcacaaactacgcggactccgtgagggaccgattcaccatctccagagacaacgccaagaacacgctgtatctgcaaatgcacagtctgagagccgacgatggcggctgtatatttctgtgcaagagatcaacgtgggtacggggacctacttttatttcaggttcgtc

SEQ ID NO: 455246 - DNA, 534 bp, Homo sapiens
  misc_feature: HEFZJCU01D9276.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagtttacgtggactctgtgaagggccgtttcaccatctccagagacaacgccaagaattcactgtatctacaactgaacagcctgagagtcgcagacacggccgtgtattactgtgcgagatgtaggaaaagtatggctgtgtttagttggggccaggggagccctggtcaccggtt

SEQ ID NO: 455247 - DNA, 507 bp, Homo sapiens
  misc_feature: HEFZJCU01CHZAM.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagctttttgactactggggccagggaaccctggtcatcgtctcctcagcctccaccaagggcccatcggtcttcccctggcaccctcctccaagagcacctctgggggcacagcggccctgggctgcctggtcaaggactacttccgagtagtaca

SEQ ID NO: 455248 - DNA, 372 bp, Homo sapiens; identical to SEQ ID NO: 444513
  misc_feature: HEFZJCU01E09G8.5.23.C01.1.454.heavy.3.raw

SEQ ID NO: 455249 - DNA, 508 bp, Homo sapiens
  misc_feature: HEFZJCU01CIZTZ.2.33.C11.1.454.heavy.3.raw
acgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtggtcctgcgactctcctgtgcaatttctgaagccccttccaatacagtgtggatgaattgggtccgccaggctccagggaaggggctggagtgggttggccatataaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggactactatagtccctggggccaggggaaccctc

SEQ ID NO: 455250 - DNA, 511 bp, Homo sapiens
  misc_feature: HEFZJCU01CEE6Y.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcacatggacctgaggagcctgagatttgacgacacggccatatattactgtgcgagagattgggccgacggaaaccttgactactggggccgagggaaccctggtcgaccgt

SEQ ID NO: 455251 - DNA, 513 bp, Homo sapiens
  misc_feature: HEFZJCU01EOUAS.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgctttgatatctggggccaagggacaatggtcaccgtctcttcagcctccaccaagggcccatcggtcttcccctggcaccctcctccaagagcacctctggggcacagcggcccg

SEQ ID NO: 455252 - DNA, 513 bp, Homo sapiens
  misc_feature: HEFZJCU01DN5X4.9.31.C09.1.454.heavy.3.raw
tgatacgtctcacgaccggtgctcgatttagacgtctcatcaaggaaggaagggggggagaggagccccagccttgggatccccaagtgttttcattcagtgatcaggactgaacacagaggactcaccatggagtttgggctgagctggattttccttgctgctattttaaaaggtgtccagtgtgaggtgcaactggtggagtctgggggaggctcggtcaagcctggggagtcccttagactctcctgtgcaacctctggattcaatttcgacatcgcctggatgagttgggcccgccaggctccagggaaggggctggagtgggttggacgtcttaaaagcaagggtagcggtgggacagcagactacgcttcatccgtgaagggcagattcagcatttccagagacgatgcaagacagatgatgtatttacagatgaacagacctaaaaatcggagacacagccctatatttctgcgtcttcatttcgcagtgggagctccggtttac

SEQ ID NO: 455253 - DNA, 492 bp, Homo sapiens; identical to SEQ ID NO: 454600
  misc_feature: HEFZJCU01DD52L.43.9.A09.1.454.heavy.3.raw

SEQ ID NO: 455254 - DNA, 437 bp, Homo sapiens; identical to SEQ ID NO: 447018
  misc_feature: HEFZJCU01BXMZD.40.27.C05.1.454.heavy.3.raw

SEQ ID NO: 455255 - DNA, 510 bp, Homo sapiens
  misc_feature: HEFZJCU01DZRE5.9.14.B03.1.454.heavy.3.raw
tgatacgtctcacgaccggtgctcgatttagtgtgagtagtttgggtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctcccgagagcacagcggccctgggctgcctggtcaaggactacttccagacgtatca

SEQ ID NO: 455256 - DNA, 510 bp, Homo sapiens
  misc_feature: HEFZJCU01AK9WG.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactggcagtggattggatacatctacttcagtgggaaccccaactacaacccctcctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaacgggcccatccggtccttccccc

SEQ ID NO: 455257 - DNA, 464 bp, Homo sapiens
  misc_feature: HEFZJCU01EL4GK.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacaacgcccagaactcactatatctgcaaatgaacagcctgagagccgacgacacggctgtgtattactgtgcgggagccgtaacttcgggggactacctcgacccctgggccagggaatactggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 455258 - DNA, 519 bp, Homo sapiens
  misc_feature: HEFZJCU01BOYDW.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgagaccacggccgtctattattgtgtcatacgacctaggatacaacgacggtggtacctggtattc

SEQ ID NO: 455259 - DNA, 499 bp, Homo sapiens; identical to SEQ ID NO: 450485
  misc_feature: HEFZJCU01CDKBF.11.73.G07.1.454.heavy.3.raw

SEQ ID NO: 455260 - DNA, 396 bp, Homo sapiens; identical to SEQ ID NO: 444426
  misc_feature: HEFZJCU01B2KLX.18.31.C09.1.454.heavy.3.raw

SEQ ID NO: 455261 - DNA, 533 bp, Homo sapiens
  misc_feature: HEFZJCU01BFH7B.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaccagttctccctgaagctgagctctgtgactgccgcggacacggccgtgtattactgtgcgaggtcgattgtgatggtaacaactgcttcttacttcctttgaccagtggggccggggaacccgtggtcaccgtctcttcagcctccaccaagggcccatcggtccttcccctcggccaccctccttcccaacgagccacctcctcggggggccaccgagcc

SEQ ID NO: 455262 - DNA, 504 bp, Homo sapiens
  misc_feature: HEFZJCU01CDGH1.14.78.H01.1.454.heavy.3.raw
cgtctagtaccacgaccggtgctcgatttagtgtgagtagtttgggtttggggagctctgggagaagagccccagccccagagttcccaggagtttccattcggtgatcagcactgaacacagaggactcaccatggagtttgggctgagctgggtcttccttgttgctattataaaaggtgtccagtgtcaagtgcagttggtggagtctgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcatgtttt

SEQ ID NO: 455263 - DNA, 501 bp, Homo sapiens
  misc_feature: HEFZJCU01DGOWE.19.86.H09.1.454.heavy.3.raw
tactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgccctgctccaggagcacctccgagagcacagcggccctgggctgcctggtcaaggactacttcccacgagagta

SEQ ID NO: 455264 - DNA, 484 bp, Homo sapiens
  misc_feature: HEFZJCU01D8Z3U.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctcgtgactcccgaggacacgggtcgtatattactgtggaagaggccccatacg

SEQ ID NO: 455265 - DNA, 492 bp, Homo sapiens
  misc_feature: HEFZJCU01BZSV7.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaagga

SEQ ID NO: 455266 - DNA, 510 bp, Homo sapiens; identical to SEQ ID NO: 447226
  misc_feature: HEFZJCU01DQ3TG.12.78.H01.1.454.heavy.3.raw

SEQ ID NO: 455267 - DNA, 521 bp, Homo sapiens
  misc_feature: HEFZJCU01BL8WZ.52.74.G08.1.454.heavy.3.raw
cgcagtacgacacgaccggtgctcgatttagtagctctatcaggggatgctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggagtggttattattgggcctggatccggcagcccccgggaaggggctggagtggatcggcagcatccatcatagtggagacaataatcacaatccgtccctcagaggacgagtcaccttttcagtggagacgtccaagaaccaattctccctgaaattgacctctctgaccgccgccgacacggccctttatactgtgcgcgagtgaacacagcaataacttattatgttgaatattggggccaggggaaccccggtcaccatctcctcagcctccaccaagggccccatcc

SEQ ID NO: 455268 - DNA, 511 bp, Homo sapiens; identical to SEQ ID NO: 445840
  misc_feature: HEFZJCU01EZCRU.11.13.B02.1.454.heavy.3.raw

SEQ ID NO: 455269 - DNA, 505 bp, Homo sapiens
  misc_feature: HEFZJCU01ELAOO.53.35.D02.1.454.heavy.3.raw
cgcgtatacacacgaccggtgctcgatttagcacacgatagttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaagggcccatcggtcttcccctggcta

SEQ ID NO: 455270 - DNA, 511 bp, Homo sapiens
  misc_feature: HEFZJCU01DFOKR.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaaccggcagttagtcacccatactactttgactactggggccg

SEQ ID NO: 455271 - DNA, 519 bp, Homo sapiens
  misc_feature: HEFZJCU01BTMO6.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccgttgttaggttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgattcaccatcctccagagacaacgccaagaattcactgtattgcaaatgaacagcctgagaggcgaggacacggccgtgtattattgtgcgcggagatggatagtagactctacagttagcagggtgta

SEQ ID NO: 455272 - DNA, 510 bp, Homo sapiens
  misc_feature: HEFZJCU01CY5HF.12.27.C05.1.454.heavy.3.raw
atacgacgtacacgaccggtgctcgatttagacgcgatcgaagggtttggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcaactggtggagtctgggggaggcttggtacagccgggggggtccctgagactctcctgtgcaggctctggattcatctttaacaactatgccatgagctgggtccgccaggctccagggaaggggctggagtgggtctcagctattagtaatagtggtgatagcacatcctacgcagactccgtgaagggccgcttcaccatctccagagacaattccaagaacacgctgtatctccaaatgaacagtctcagagccgaggacacgggccatatattactgtgcgaaagacacaagccgcatttgggggagtcatcgt

SEQ ID NO: 455273 - DNA, 489 bp, Homo sapiens; identical to SEQ ID NO: 445569
  misc_feature: HEFZJCU01DIC5D.12.75.G09.1.454.heavy.3.raw

SEQ ID NO: 455274 - DNA, 514 bp, Homo sapiens
  misc_feature: HEFZJCU01CIAKR.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacgggctgtgtattactgtgcgagagcggctggcaactacatccattacggtttggacgtctggggccaagggaccacggtcatcgtctccccagcctccaccaagggcccatcggtcttcccctggcgccctgctccaggagcacc

SEQ ID NO: 455275 - DNA, 491 bp, Homo sapiens; identical to SEQ ID NO: 444592
  misc_feature: HEFZJCU01A4K3H.11.26.C04.1.454.heavy.3.raw

SEQ ID NO: 455276 - DNA, 484 bp, Homo sapiens
  misc_feature: HEFZJCU01EN8JF.19.71.G05.1.454.heavy.3.raw
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccccatagacatgccacctcgtctctggtgctt

SEQ ID NO: 455277 - DNA, 497 bp, Homo sapiens; identical to SEQ ID NO: 445179
  misc_feature: HEFZJCU01DVADB.12.55.E11.1.454.heavy.3.raw

SEQ ID NO: 455278 - DNA, 511 bp, Homo sapiens
  misc_feature: HEFZJCU01EYOO4.10.38.D05.1.454.heavy.3.raw
catagtagtgcacgaccggtgctcgatttagtatctgatagttgggtttgggtgccgaagttgctggaggtcacggtcaccacgctgctgagggagtagggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccactcggtccttccccctcggccgccctcgcctcccaggagcaccctccgagacgcacagcggccctgggctgcctggtcaaggactacttcccactact

SEQ ID NO: 455279 - DNA, 559 bp, Homo sapiens
  misc_feature: HEFZJCU01CQHFE.15.86.H09.1.454.heavy.3.raw
tctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtaggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaaatgatggtgagaaaatagactacggtgcacccgtgaaaggaagattcaccatctcaagagataattcaaaaacgacggtgtatttgcaaatgaacagcctgaaaaccgaggacacagccgtctattactgtaccacagattcggaagtgcatcgacgtaaaggaggctatgcttttgtatatctggggcccagggacaatggtcgtcgtctcttcagcctccacaggcccatcgtcttcccctggcaccctcctccaacg

SEQ ID NO: 455280 - DNA, 507 bp, Homo sapiens; identical to SEQ ID NO: 448371
  misc_feature: HEFZJCU01D6VE0.3.81.H04.1.454.heavy.3.raw

SEQ ID NO: 455281 - DNA, 532 bp, Homo sapiens
  misc_feature: HEFZJCU01DHUDS.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggcctttcacaggggcggtttgtcttctccatggatacctctgtcgggacggcttatctgcagataaccaaccttcaacctgacgacactgccgtttattttgtacgtagagcgtcgtctgtcagtggaattgactactgggccagggaacctggtcaccgtctcctcagcctccaccaaggg

SEQ ID NO: 455282 - DNA, 503 bp, Homo sapiens
  misc_feature: HEFZJCU01EQ1IA.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctgcgccctgctccaggagcacctccgagagcacagcggccctgggctgcctggtcaaggactactcccactacta

SEQ ID NO: 455283 - DNA, 518 bp, Homo sapiens
  misc_feature: HEFZJCU01D0ISO.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgacccgtgaagggccgattaaccatctccagagacgattccgagaacacggtgtatcttcaaatgaacaacctgagagccgacgacacggccgtttattactgtgcgagagattcgagtggttcggggacctcacctggtctacttcgatctcgtgggg

SEQ ID NO: 455284 - DNA, 392 bp, Homo sapiens; identical to SEQ ID NO: 444682
  misc_feature: HEFZJCU01A4LAF.16.70.G04.1.454.heavy.3.raw

SEQ ID NO: 455285 - DNA, 378 bp, Homo sapiens; identical to SEQ ID NO: 444463
  misc_feature: HEFZJCU01A2RFM.47.77.G11.1.454.heavy.3.raw

SEQ ID NO: 455286 - DNA, 502 bp, Homo sapiens
  misc_feature: HEFZJCU01ESBMN.9.33.C11.1.454.heavy.3.raw
  modified_base (418)..(418): a, c, t, g, unknown or other
tgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtnttcccctggcgccctgctccagagcacctccgagagcacagcggccctgggctgcctggtcaaggactacttccagacgtatca

SEQ ID NO: 455287 - DNA, 491 bp, Homo sapiens; identical to SEQ ID NO: 447981
  misc_feature: HEFZJCU01DVAHB.47.85.H08.1.454.heavy.3.raw

SEQ ID NO: 455288 - DNA, 519 bp, Homo sapiens
  misc_feature: HEFZJCU01DBL95.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccgagcgggagttccaagtactcctttgacgtctgggccgtac

SEQ ID NO: 455289 - DNA, 527 bp, Homo sapiens
  misc_feature: HEFZJCU01ATDV1.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctgggccggggaaccctggtcaccgtctccccaccctccaccg

SEQ ID NO: 455290 - DNA, 507 bp, Homo sapiens
  misc_feature: HEFZJCU01EM073.3.55.E11.1.454.heavy.3.raw
agacgcactccacgaccggtgctcgatttagcactcgcacgttgggtttgggattcacgttgcagatgtaggtccctgagactctcctgtgcagcctctggattcaccttcagtagatatgctatgtattgggtccgtcaggctccaggcaaggggctggagtgggtggcagttatgtcacatgatggaagaaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccagggaaccctggtcaccgtctcctcagcctccaccaagggcccatcggtcttcccctggccaccctcctccaagagcacctctgggggcacagcggccctggctgcctggtcaaggactactccgagtgcgtct

SEQ ID NO: 455291 - DNA, 517 bp, Homo sapiens
  misc_feature: HEFZJCU01C3MNJ.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcacctggttctacttcgatctct

SEQ ID NO: 455292 - DNA, 499 bp, Homo sapiens
  misc_feature: HEFZJCU01D9H1A.15.70.G04.1.454.heavy.3.raw
tctacgtagccacgaccggtgctcgatttagtgtagtgtgaagggaaagggggaagaccgatgggcccttggtgaagccttcggagaccctgtccctcacctgcactgtctctggtgactccatcagtccttactactggacctggatccggcagcccccagggaagggactggagtggattggatatatctattacagtgggggcaccaactacaacccctccctcaagagtcgagtcatcatttcagtagacacgtccaagaaccagttctccctgaagatgagctctgtgaccgccgctgacacggccgtctattattgtgcgagacatcggcacctaagttggttcgacccctggggccagggaacccgggtcaccgtcgcctcagcctccaccaagggcccatcggtcttccccctggccacctcctccaagagcacctctgggggcacagcggccctgggctgcctggtcaaggactacttccgctacgtaga

SEQ ID NO: 455293 - DNA, 504 bp, Homo sapiens
  misc_feature: HEFZJCU01EFA3B.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtggggcaccagctacaacccctccctcaagagccgcgtcaccatttcagtagacacgtccaagaaccagctctccctgaagctgagttctgtgaccgccgcagacacggccgtgtattactgtgtgcgacaggtggacgtctggggccaagggaccacggtcaccgtctcctcagcctccaccaagggccc

SEQ ID NO: 455294 - DNA, 498 bp, Homo sapiens; identical to SEQ ID NO: 445952
  misc_feature: HEFZJCU01BN3MN.11.71.G05.1.454.heavy.3.raw

SEQ ID NO: 455295 - DNA, 506 bp, Homo sapiens
  misc_feature: HEFZJCU01C9E0Q.10.38.D05.1.454.heavy.3.raw
  modified_base (439)..(439): a, c, t, g, unknown or other
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctganagtcgacgacacggccacctattattgtgcgcgacatgactacgctcaattctggggccaggggacg

SEQ ID NO: 455296 - DNA, 379 bp, Homo sapiens; identical to SEQ ID NO: 444549
  misc_feature: HEFZJCU01BHYNC.47.77.G11.1.454.heavy.3.raw

SEQ ID NO: 455297 - DNA, 509 bp, Homo sapiens; identical to SEQ ID NO: 445225
  misc_feature: HEFZJCU01D00AS.9.78.H01.1.454.heavy.3.raw

SEQ ID NO: 455298 - DNA, 516 bp, Homo sapiens
  misc_feature: HEFZJCU01CHHOD.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaacgttactacgctatggacgtctggggccaagggga

SEQ ID NO: 455299 - DNA, 522 bp, Homo sapiens
  misc_feature: HEFZJCU01APG3T.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactggggccagggaagcttggtcaccgtctcctcagcctcc

SEQ ID NO: 455300 - DNA, 505 bp, Homo sapiens
  misc_feature: HEFZJCU01EWEW0.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagtggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctgcgccctgctccaggagcacctctggggcacagcggcctggctgcctggtcaaggctactcccata

SEQ ID NO: 455301 - DNA, 541 bp, Homo sapiens
  misc_feature: HEFZJCU01EAAQG.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggaccacccccaaaaaccaggtggtccttacaatgacccaccatggaccctgtggacacagccacatatttctgtgcacactctataggagcacctggtagtctgccaaactggttcgacccgtcggggcccgggaacccgtggtcaccgtctcctcacgcctccaccaacgggcccatcggtccttcccctc

SEQ ID NO: 455302 - DNA, 491 bp, Homo sapiens; identical to SEQ ID NO: 447981
  misc_feature: HEFZJCU01DB05X.47.85.H08.1.454.heavy.3.raw

SEQ ID NO: 455303 - DNA, 479 bp, Homo sapiens; identical to SEQ ID NO: 450171
  misc_feature: HEFZJCU01BNUIQ.14.70.G04.1.454.heavy.3.raw

SEQ ID NO: 455304 - DNA, 479 bp, Homo sapiens; identical to SEQ ID NO: 450171
  misc_feature: HEFZJCU01BTLFV.14.70.G04.1.454.heavy.3.raw

SEQ ID NO: 455305 - DNA, 470 bp, Homo sapiens; identical to SEQ ID NO: 444866
  misc_feature: HEFZJCU01DYOXG.4.36.D03.1.454.heavy.3.raw

SEQ ID NO: 455306 - DNA, 490 bp, Homo sapiens
  misc_feature: HEFZJCU01A8UHZ.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttccccctggcaccctcctccaagagcacctctgggggcacagcggccctgggctgcctggtcaggactacttccgagtgcgct

SEQ ID NO: 455307 - DNA, 490 bp, Homo sapiens; identical to SEQ ID NO: 444500
  misc_feature: HEFZJCU01EG36A.19.53.E09.1.454.heavy.3.raw

SEQ ID NO: 455308 - DNA, 501 bp, Homo sapiens; identical to SEQ ID NO: 445027
  misc_feature: HEFZJCU01AZ34D.26.23.C01.1.454.heavy.3.raw

SEQ ID NO: 455309 - DNA, 527 bp, Homo sapiens
  misc_feature: HEFZJCU01DXHZB.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccgacaacccaacctacgcccagggtttcaccggacgctttgtcttctccttggatacctctgtcagggcggcgtatctgcagatcaccagtcttcaggctgaggacactgccatttattactgtgcgagagagggggagagtggagtagaacgtaaatacgggaaaccgtttgacttttgggccagggaaccctggtcaccgtctcctcagcctccaccaagggcccatcggtcttcccctggcaccctcctccaagagcacctctgggggcacagcggccctgggctg

SEQ ID NO: 455310 - DNA, 532 bp, Homo sapiens
  misc_feature: HEFZJCU01CF6K0.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccaattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaagggcccatcggtcttccccctggcaccctcctccaagagcacctct

SEQ ID NO: 455311 - DNA, 427 bp, Homo sapiens; identical to SEQ ID NO: 444708
  misc_feature: HEFZJCU01ARLLQ.9.34.D01.1.454.heavy.3.raw

SEQ ID NO: 455312 - DNA, 518 bp, Homo sapiens
  misc_feature: HEFZJCU01C9A6R.3.17.B06.1.454.heavy.3.raw
  modified_base (429)..(429): a, c, t, g, unknown or other
agacgcactccacgaccggtgctcgatttagtcgatagtgaagggggagagcggagccccagccccagaattcccaggtgttttcatttggtgatcagcactgaacacagaggactcaccatggagtttgggctgagcgtgggttttccttgttgttattttacaaggtgtccagtgtgaggtgcacctggtggagtctgggggagcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttanctgcaaatgaacagcctgagaaccgacgacacggccgtctattattgtgtcatagacctaggatacaacggacgtggtacctggtattc

SEQ ID NO: 455313 - DNA, 524 bp, Homo sapiens
  misc_feature: HEFZJCU01DTF4C.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgacccagtggggccgggggaacccgtggtcaccgtctcttcagcctccaccaagggcccatcggtcttcccctggcaccctcctccaagagcacctctcgggggcacgagcc

SEQ ID NO: 455314 - DNA, 398 bp, Homo sapiens; identical to SEQ ID NO: 444524
  misc_feature: HEFZJCU01B5JGH.7.60.F05.1.454.heavy.3.raw

SEQ ID NO: 455315 - DNA, 525 bp, Homo sapiens
  misc_feature: HEFZJCU01B745M.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaagggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccac

SEQ ID NO: 455316 - DNA, 502 bp, Homo sapiens
  misc_feature: HEFZJCU01DDVO2.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcattcgtacaatttgataggctctatggactggacttctc

SEQ ID NO: 455317 - DNA, 545 bp, Homo sapiens
  misc_feature: HEFZJCU01C4972.15.86.H09.1.454.heavy.3.raw
tctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaatagactacggtgcacccgtgaaaggaagattcaccatctcaagagataattcaaaacgacggtgtatttgcaaatgaacagcctgaaaaccgaggacacagccgtctattactgtaccacagattcggaagtgcatcgacgtaaaggaggctatgcttttgatatctggggcccaggggacaagtc

SEQ ID NO: 455318 - DNA, 495 bp, Homo sapiens
  misc_feature: HEFZJCU01DQZQD.16.37.D04.1.454.heavy.3.raw
tgtactactccacgaccggtgctcgatttagtagcatactgtgggtttggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 455319 - DNA, 490 bp, Homo sapiens
  misc_feature: HEFZJCU01BOWK8.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgacgagcacagcggccctgggctgcctggtcaaggactacttcccatactcgta

SEQ ID NO: 455320 - DNA, 502 bp, Homo sapiens; identical to SEQ ID NO: 444768
  misc_feature: HEFZJCU01CD5P7.21.70.G04.1.454.heavy.3.raw

SEQ ID NO: 455321 - DNA, 509 bp, Homo sapiens
  misc_feature: HEFZJCU01B8HM5.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactggggcccgggagccctggt

SEQ ID NO: 455322 - DNA, 506 bp, Homo sapiens; identical to SEQ ID NO: 444696
  misc_feature: HEFZJCU01BW73D.16.34.D01.1.454.heavy.3.raw

SEQ ID NO: 455323 - DNA, 523 bp, Homo sapiens
  misc_feature: HEFZJCU01C7XWC.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctggctgcctggtcaaggactacttcc

SEQ ID NO: 455324 - DNA, 503 bp, Homo sapiens
  misc_feature: HEFZJCU01ASAZU.48.53.E09.1.454.heavy.3.raw
agtatacatacacgaccggtgctcgatttagagagagtgtgttgggtttggggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggaggg

SEQ ID NO: 455325 - DNA, 486 bp, Homo sapiens; identical to SEQ ID NO: 444861
  misc_feature: HEFZJCU01DUFBS.47.55.E11.1.454.heavy.3.raw

SEQ ID NO: 455326 - DNA, 531 bp, Homo sapiens
  misc_feature: HEFZJCU01DXCZQ.19.48.E04.1.454.heavy.3.raw
tactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggccccgccaggctccggggaagggccggagtgggtggccaacataatgcaagatggaactgagaaaactatggggactctgtgaagggccgattcaccatctccagagacaaccgtaagaacttactgttctgcaaatgaacagcctgagagccgaggacacggctgtgtattattgtgcgaagggcagtggctggggacatggacgtctggggccaaggggaccacggtcaccgt

SEQ ID NO: 455327 - DNA, 517 bp, Homo sapiens
  misc_feature: HEFZJCU01DZN5Z.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggcgccctcgctccaggagcacctccgagagcacagcggccc

SEQ ID NO: 455328 - DNA, 478 bp, Homo sapiens; identical to SEQ ID NO: 450660
  misc_feature: HEFZJCU01EIMH1.16.10.A10.1.454.heavy.3.raw

SEQ ID NO: 455329 - DNA, 518 bp, Homo sapiens
  misc_feature: HEFZJCU01CWXI9.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccagggacaacgccaagaactcactgactttgcaaatgaacacctgcgagccgaggacacggccgtatattactgtgcgagaataacccgttcgcctggttattacc

SEQ ID NO: 455330 - DNA, 484 bp, Homo sapiens
  misc_feature: HEFZJCU01A4IWZ.51.14.B03.1.454.heavy.3.raw
cgatcgtatacacgaccggtgctcgatttagtgtgagtagtttgggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactgggccagggaaccctggtcaccgtctcctcagcctccaccaagggcccatcggtcttcccctggcaccctcctccaagagcacctctgggggcacagcgccctgggctgcctggtcaaggactacttcctcgtagcact

SEQ ID NO: 455331 - DNA, 503 bp, Homo sapiens
  misc_feature: HEFZJCU01EFN2C.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtgggccaagggacaatggtcaccgt

SEQ ID NO: 455332 - DNA, 513 bp, Homo sapiens
  misc_feature: HEFZJCU01DPXNY.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacacgcctgagagccgacgacacggccatatattactgtgcgaaagcaccggcagttagtcacccatactactttgactactggggccaac

SEQ ID NO: 455333 - DNA, 541 bp, Homo sapiens
  misc_feature: HEFZJCU01DN9NJ.12.85.H08.1.454.heavy.3.raw
atacgacgtacacgaccggtgctcgatttagtatcactcagtcgcgggaggtctgagagaggagcccagccctaggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaagggccggttcaccatctccagagacgaattccaagaaaacactgtatctgcaattaccagcctgagagtcgaggacacggccctttattactgtgcgaaggatcgccctataatggtggttggatcggggatttggttcctggggccagggaaccctggtctaccg

SEQ ID NO: 455334 - DNA, 526 bp, Homo sapiens; identical to SEQ ID NO: 450606
  misc_feature: HEFZJCU01CSRER.48.4.A04.1.454.heavy.3.raw

SEQ ID NO: 455335 - DNA, 529 bp, Homo sapiens
  misc_feature: HEFZJCU01CRI22.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttactgacccctggggccggggaaccctggtcaccgtctccccaccctccaaccg

SEQ ID NO: 455336 - DNA, 509 bp, Homo sapiens; identical to SEQ ID NO: 444586
  misc_feature: HEFZJCU01ECEV0.12.78.H01.1.454.heavy.3.raw

SEQ ID NO: 455337 - DNA, 504 bp, Homo sapiens; identical to SEQ ID NO: 445222
  misc_feature: HEFZJCU01BTBYG.9.33.C11.1.454.heavy.3.raw

SEQ ID NO: 455338 - DNA, 512 bp, Homo sapiens
  misc_feature: HEFZJCU01DICS4.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccgttcaccatctccagagacaattccaagaacacactgtatctgcaaatgaacagcctgagagccgacgacacggccatatattactgtgcgaaagcaaccggcagttagtcacccatacctactttgactacgtggggccg

SEQ ID NO: 455339 - DNA, 512 bp, Homo sapiens; identical to SEQ ID NO: 451002
  misc_feature: HEFZJCU01BUFBG.13.36.D03.1.454.heavy.3.raw

SEQ ID NO: 455340 - DNA, 507 bp, Homo sapiens
  misc_feature: HEFZJCU01BDCQ3.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaggagggggaacagcggagtcagtactcttgacgtctgggccac

SEQ ID NO: 455341 - DNA, 418 bp, Homo sapiens
  misc_feature: HEFZJCU01C2KZY.11.37.D04.1.454.heavy.3.raw
cgagagataccacgaccggtgctcgatttagtagcatactgttgggtgcgacaggcccctgggcaaggacttgagtggatgggacagatccacccttacactggcgacacaatttatgcacagaaatttcagggcagatttaccctgaccgaggacacggccatcaccacagtctacatggacctgaagagactgacaattaacgacacggccaaatattattgtgtcagagacaagactcaattttgtgttcgtggtcactgctggttcgacccctggggccagggaaccctgatcacgtctcctctgcctccaccaagggcccatcggtcttccccctggcaccctcctccaagagcacctctgggggcacagcggccctgggctgcctggtcaaggactacttccgtatctctcg

SEQ ID NO: 455342 - DNA, 527 bp, Homo sapiens
  misc_feature: HEFZJCU01AH99P.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggaggccgattcaccgtctccagagacaattccaagaacagggtgtttctccaagtgattgatctgagaagtgaggacacggctgtttattactgtgcgcggtggctgaccgctcttgactacgtgggggccggggagccccgggtcatcgtct

SEQ ID NO: 455343 - DNA, 518 bp, Homo sapiens
  misc_feature: HEFZJCU01B5PYE.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccagggcccatcggtctcccctgcg

SEQ ID NO: 455344 - DNA, 489 bp, Homo sapiens
  misc_feature: HEFZJCU01DDJBS.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgctggtcaggactacttccgtatctctcg

SEQ ID NO: 455345 - DNA, 503 bp, Homo sapiens
  misc_feature: HEFZJCU01COALC.10.23.C01.1.454.heavy.3.raw
catagtagtgcacgaccggtgctcgatttagtacacgtgattagggattgggaggcttggtacagcctggcaggtccctgagactctcctgtgcagcctctggattcagctttgatgaatatgccatggactgggtccggcaagttccagggaagggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagagggagtcagggtttcaactattatagtagtggttatgactactggggccagggaaccctggtcaccgtctcctcagcctccaccaagggcccatcggtcttcccctggcgccctgctccaggagcacctccgacgagcacagcggccctgggctgcctgtcaaggactacttcccactactat

SEQ ID NO: 455346 - DNA, 537 bp, Homo sapiens
  misc_feature: HEFZJCU01CJVWT.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactactggggccagggaaccctggtcaccgtctcctcagcctccaccaacgggccc

SEQ ID NO: 455347 - DNA, 383 bp, Homo sapiens
  misc_feature: HEFZJCU01B2SZS.47.60.F05.1.454.heavy.3.raw
agctcacgtacacgaccggtgctcgatttagtacgtcatcagggaaagggactggagtggattggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaagggcccatcggtcttccccctgacaccctcctccaagagcacctctgggggcacagcggccctgggctgcctggtcaaggactacttcctacgtgagct

SEQ ID NO: 455348 - DNA, 520 bp, Homo sapiens
  misc_feature: HEFZJCU01EKTCY.49.45.E01.1.454.heavy.3.raw
agtcgagagacacgaccggtgctcgatttagtgagtcagtaagggaaaggggtctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaagccgggggggtccctgagactctcctgtgcagcctctggattcaccttccgttcctataccatgaactggatccgccaggctccagggaggcgactggagtgggtctcatctattagtggtagaggtgattactacaactacgcagactcactggagggccgattcaccatctccagagacaacaccaagaatttactgtatctgcaaatggacagcctgagagccgacgacacggctgtctattactgtgcgagagttcgggatattgccgtagtcccagatgtcccgacctaacg

SEQ ID NO: 455349 - DNA, 413 bp, Homo sapiens; identical to SEQ ID NO: 444985
  misc_feature: HEFZJCU01A89RS.4.36.D03.1.454.heavy.3.raw

SEQ ID NO: 455350 - DNA, 508 bp, Homo sapiens
  misc_feature: HEFZJCU01C3OS4.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactactatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccaggggacg

SEQ ID NO: 455351 - DNA, 513 bp, Homo sapiens
  misc_feature: HEFZJCU01B4CW7.51.31.C09.1.454.heavy.3.raw
cgatcgtatacacgaccggtgctcgatttagacgtctcatcaaggaaggaaggggagctctgagagaggagcccagccctgggattttcaggtgttttcatgtggtgatcaggactgaacagagagaactcaccatggagtctgggctgacgtgactttttcttgtggctattttaaaaggtgtccagtgtgacgtgcagctggtggagtctgggggaggcttgatacagccgggggggtccctgagactctcatgtagaacctctggcttcatgtttagagtctatgacatgagttgggtccgccaggctccggggaaggggctggagtgggtctcaatgatcagtgatggtggaacgaccacaaactacgccgactccgtgaagggccggtgcaccatctccagagacaattcgaaggacactttatatctgcaactcaacagactgacacccgcggacacggccgtctactactgtgtgaaagagacggaccgctggacgaggagccaga

SEQ ID NO: 455352 - DNA, 402 bp, Homo sapiens
  misc_feature: HEFZJCU01D9VFF.10.77.G11.1.454.heavy.3.raw
catagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggacgtctggggccaagggaccacggtcaccgtctcctcagcctccaccaagggcccatcggtcttccccctggcaccctcctccaagagcacctctggggcacagcggccctgggctgcctggtcaaggactacttcccactactatg

SEQ ID NO: 455353 - DNA, 465 bp, Homo sapiens
  misc_feature: HEFZJCU01EBY4J.14.68.G02.1.454.heavy.3.raw
cgtctagtaccacgaccggtgctcgatttagtcgatagtgaagggaaagggtgtacacctgtggttctcactcaccgatggtcgattgggtgtgagctggatccgtcagtccccagggaaggccctggagtggcttgcacacatgtattggaatgacgaaaatcgtacaggaaatctctgcagagcaggctcatcatctccagggacacatccaaaagccaggtggtccttaccatgaccaacatggaccctgtggacacagccacatattactgtgcacggatcgtttattattacggttcggggagctccaagcttgactactggggccagggaaccctggtcaccgtctcctcagcctccaccaagggcccatcggtcttccccctggcaccctcctccaagagcacctctgggggcacagcggccctgggctgcctggtcggactacttccgtactagacg

SEQ ID NO: 455354 - DNA, 499 bp, Homo sapiens
  misc_feature: HEFZJCU01C5DK2.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaaggacttaccg

SEQ ID NO: 455355 - DNA, 496 bp, Homo sapiens
  misc_feature: HEFZJCU01AJMHD.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgcctttcggtccgcgggacttc

SEQ ID NO: 455356 - DNA, 481 bp, Homo sapiens; identical to SEQ ID NO: 445006
  misc_feature: HEFZJCU01EAS7J.7.10.A10.1.454.heavy.3.raw

SEQ ID NO: 455357 - DNA, 476 bp, Homo sapiens
  misc_feature: HEFZJCU01DZHK8.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctgggcctcagtgaaggtctcctgcaaggcttctggatacaccttcaccgcctactatatgcactgggtgcgactggcccctggacaagggcttgagtggatgggatggatcgaccctaacagcggtggcacaagtatgcacagaagtttcagggcagggtcaccatgaccagggacacgtccatcagcacgtcatcagcacagcctacatggacctgacgcggcctgacatctgacgacacggccgtatattctgtgcgaggg

SEQ ID NO: 455358 - DNA, 498 bp, Homo sapiens
  misc_feature: HEFZJCU01EN1S7.53.78.H01.1.454.heavy.3.raw
cgcgtatacacacgaccggtgctcgatttagtgtgagtagtttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtgccgttcgacccctggggccagggaaccctggtcaccgtctcctcagcttccaccaaggcccatcggtcttcccc

SEQ ID NO: 455359 - DNA, 533 bp, Homo sapiens
  misc_feature: HEFZJCU01CCO4H.48.76.G10.1.454.heavy.3.raw
agtatacatacacgaccggtgctcgatttagtcactcatacaggggtgggagaggagccccagccggtgagattcccaggagttttcacttggtgatcagccctgaaaacagaccaccaaccatggagtttgggcttaactgggttttccttgttgctattttaaaaggtgcccaatgtgaggtgcagctggtggagtctgggggagccttggtacagccaggggggtccctgagactctcctgttcaacttctggattcacctttggtgattatattatgagttgggtccgccaggcgccagggaaggcactggagtgggttgctttcattagtcccaaactttctggtgggacagcatactacgccccgccagaatatgccgcgtctgtgcaaggcagattcaccatgtcaagagatgaatccaaaggtatcgcctatctgcaaatgaacagcctgaaaaccgaggacacagccgtctattactgtactagagcctattttgtacatctggtgtatttcaccttcccgtcg

SEQ ID NO: 455360 - DNA, 515 bp, Homo sapiens
  misc_feature: HEFZJCU01ESMHR.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggagttttacgtatttttggagtggatattaa

SEQ ID NO: 455361 - DNA, 505 bp, Homo sapiens; identical to SEQ ID NO: 449275
  misc_feature: HEFZJCU01ACRQR.13.39.D06.1.454.heavy.3.raw

SEQ ID NO: 455362 - DNA, 518 bp, Homo sapiens; identical to SEQ ID NO: 446027
  misc_feature: HEFZJCU01C6VEC.9.34.D01.1.454.heavy.3.raw

SEQ ID NO: 455363 - DNA, 400 bp, Homo sapiens; identical to SEQ ID NO: 444452
  misc_feature: HEFZJCU01C0ESX.47.24.C02.1.454.heavy.3.raw

SEQ ID NO: 455364 - DNA, 481 bp, Homo sapiens; identical to SEQ ID NO: 448054
  misc_feature: HEFZJCU01A34Z3.22.36.D03.1.454.heavy.3.raw

SEQ ID NO: 455365 - DNA, 500 bp, Homo sapiens; identical to SEQ ID NO: 444864
  misc_feature: HEFZJCU01C6NVZ.9.30.C08.1.454.heavy.3.raw

SEQ ID NO: 455366 - DNA, 516 bp, Homo sapiens
  misc_feature: HEFZJCU01DG1F3.51.31.C09.1.454.heavy.3.raw
cgatcgtatacacgaccggtgctcgatttagacgtctcatcaaggaaggaaggggtctgagagaggagcccagccctgggattttcaggtgttttcatgtggtgatcaggactgaacagagagaactcaccatggagtctgggctgacgtggctttttcttgtggctattttaaaaggtgtccagtgtgacgtgcagctggtggagtctgggggaggcttgatacagccgggggggtccctgagactctcatgtagaacctctggcttcatgtttagagtctatgacatgagttgggtccgccaggctccggggaagggctggagtgggtctcaatgatcagtgatggtgaacgaccacaaactacgccgactccgtgaagggccggtgcaccatctccagagacaattcgaaggacactttatatctgcaactcaacagactgacacccgcggacacggccgtctactactgtgtgaaagagacggaccgcgtaggacgaggagccagaggagaa

SEQ ID NO: 455367 - DNA, 379 bp, Homo sapiens; identical to SEQ ID NO: 444450
  misc_feature: HEFZJCU01CAVNY.47.77.G11.1.454.heavy.3.raw

SEQ ID NO: 455368 - DNA, 519 bp, Homo sapiens
  misc_feature: HEFZJCU01C90KL.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggcccgtgtattactgtgcgaggtcgattgtgatggtaacaactgcttcttactcctttgtaccagtgggccggggaaccctggtcaccgtctcttcagcctccaccaagggccatcggtcttcccctggcaccctcctccaagagcacctctgggggcacagcc

SEQ ID NO: 455369 - DNA, 513 bp, Homo sapiens; identical to SEQ ID NO: 446699
  misc_feature: HEFZJCU01ERNML.12.25.C03.1.454.heavy.3.raw

SEQ ID NO: 455370 - DNA, 489 bp, Homo sapiens; identical to SEQ ID NO: 444791
  misc_feature: HEFZJCU01CO4BG.47.85.H08.1.454.heavy.3.raw

SEQ ID NO: 455371 - DNA, 498 bp, Homo sapiens
  misc_feature: HEFZJCU01CWBQ0.53.14.B03.1.454.heavy.3.raw
cgcgtatacacacgaccggtgctcgatttagtgtgagtagttccgcgggcctggcgcacccaatggatagcatgggtactgagggtgtatccagaagcctggcaggaaaccttcactgaggccccaggcttcttcgcctcagccccagactgcacaagctggacctgggagtgggcacctgtggctgctgccaccaaaagaggatcctccaggtccagtccatggtgaggcgttgtgctctgggggcttctgaggagggatgtggttgttgggtcagcgctggcaatggtgacagacactattcacagaagttccagggcagagtcaccatcaccagggacacatccgcgagcacagcctacatggaactgagcagcctgagatctgaagacacgggtgtatattactgtgcgagagggaagtgggatattgtagatgcgccaggtgcccggccggccccctatttgactactggggccggggaaccctggtcaccgt

SEQ ID NO: 455372 - DNA, 505 bp, Homo sapiens
  misc_feature: HEFZJCU01CGABH.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtcgacccctcgactgataaaccggactggttcgaccccgtggggccgagggaaccctggtcaccgtctcctcg

SEQ ID NO: 455373 - DNA, 489 bp, Homo sapiens
  misc_feature: HEFZJCU01BZ6T8.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggaggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagcacctccgagagcacagcggccctgggctgcctggtcaaggactacttccgtatctct

SEQ ID NO: 455374 - DNA, 521 bp, Homo sapiens
  misc_feature: HEFZJCU01AS05A.48.29.C07.1.454.heavy.3.raw
agtatacatacacgaccggtgctcgatttagagtgctacgaagggaaagggggctttctgagagtcagggatctcatgtgcaagaaaatgaagcacctgtggttcttcctcctgctggtggcggctcccagatgggtcctgtcccagctgcagctgcaggagtcgggcccaggactggtgaagctttcggagaccctgtccctcacctgcactgtctctggtggctccatcagcagtagtagttactactggggttggatccgccagcccccagggaaggggctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactgtgtgagacgggtgccccaagaaaagtgtttatccctggggccagggaacctggtcaccgtctcctcagcctccaccaaggcccatcc

SEQ ID NO: 455375 - DNA, 319 bp, Homo sapiens
  misc_feature: HEFZJCU01AUSH0.12.58.F03.1.454.heavy.3.raw
atacgacgtacacgaccggtgctcgatttagtctgatcgagaagggaaaggggcagagaggagccttagccctggactccaaggcctttccacttggtgatcagcactgagcacagaggactcaccatggaattggggctgagctgggttttccttgttgctattttagaaggtgtccagtgtgagggacaattgtcaccgtctcttcagcctccaccaagggcccatcggtcttccccctggcgccctgctccaggagcacctccgagagcacagcggccctgggctgcctggtcaaggactacttcctacgtcgtat

SEQ ID NO: 455376 - DNA, 510 bp, Homo sapiens
  misc_feature: HEFZJCU01A3S1I.12.14.B03.1.454.heavy.3.raw
atacgacgtacacgaccggtgctcgatttagtgtgagtagtttgagtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttccccctggcaccctcctccaagagcacctctgggggcacagcggccctgggctgcctggtcaaggactacttcctacgtcgtat

SEQ ID NO: 455377 - DNA, 503 bp, Homo sapiens
  misc_feature: HEFZJCU01DXPOA.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtgggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttggattaggctctatggactggacttcgtc

SEQ ID NO: 455378 - DNA, 504 bp, Homo sapiens; identical to SEQ ID NO: 445648
  misc_feature: HEFZJCU01D97F4.17.25.C03.1.454.heavy.3.raw

SEQ ID NO: 455379 - DNA, 496 bp, Homo sapiens; identical to SEQ ID NO: 446592
  misc_feature: HEFZJCU01C0HEK.4.75.G09.1.454.heavy.3.raw

SEQ ID NO: 455380 - DNA, 467 bp, Homo sapiens; identical to SEQ ID NO: 445159
  misc_feature: HEFZJCU01DJJBC.48.7.A07.1.454.heavy.3.raw

SEQ ID NO: 455381 - DNA, 520 bp, Homo sapiens
  misc_feature: HEFZJCU01CZK7D.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctggggccaggggaccctggtcatcgtctccccagcctccaccaaggcccatcggtcttcccctggccg

SEQ ID NO: 455382 - DNA, 489 bp, Homo sapiens
  misc_feature: HEFZJCU01AR4AH.49.28.C06.1.454.heavy.3.raw
agtcgagagacacgaccggtgctcgatttagagctcacgtattgggtttggggtgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatctgcaaatgaacaggctgagagctgaagacacggctttatatttactgtgcgaactttaatcaac

SEQ ID NO: 455383 - DNA, 519 bp, Homo sapiens
  misc_feature: HEFZJCU01D5CXB.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttccgaccctgggccagggaaccctggtcaccgtctcctcagcctccaccaagggcccatcggtccttcccctcggcaccctcctccaagagcacctctgggggcacagcggccctgggctgcctggtcaaggactactccgagtagtacac

SEQ ID NO: 455384 - DNA, 506 bp, Homo sapiens; identical to SEQ ID NO: 445864
  misc_feature: HEFZJCU01A7RC7.13.37.D04.1.454.heavy.3.raw

SEQ ID NO: 455385 - DNA, 327 bp, Homo sapiens; identical to SEQ ID NO: 444439
  misc_feature: HEFZJCU01EPETW.40.20.B09.1.454.heavy.3.raw

SEQ ID NO: 455386 - DNA, 503 bp, Homo sapiens
  misc_feature: HEFZJCU01DQ5GS.10.38.D05.1.454.heavy.3.raw
  modified_base (431)..(431): a, c, t, g, unknown or other
  modified_base (448)..(448): a, c, t, g, unknown or other
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttattgaaacagatggcactacatattattctgactccgtgaagggccggttcaccctctccagagacacttccaacaacatcttgtatcttcacatgcanaatctgagagtcgacgnacggccacctattattgtgcgcgacatgactacgctcaatctggggccagggacg

SEQ ID NO: 455387 - DNA, 492 bp, Homo sapiens
  misc_feature: HEFZJCU01BGJL2.52.76.G10.1.454.heavy.3.raw
cgcagtacgacacgaccggtgctcgatttagtcactcatacagggggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggaggcgtggtccagcctgggaggtccctgagactctcctgtgcaggctctgcatttcccttcaataactatgctatcgattgggtccgccaggctccaggcaagggactggagtgggtggcagtaatatcagctgatgggaggcactaaatattacgcagattctgcggaggggccgattcaccatatccagagacaactcccaagatatgatatatctacaaatgaacagcctgagacctgaggacacggctgtatattactgtgcgtcgagggggcagtgcctggcctacg

SEQ ID NO: 455388 - DNA, 495 bp, Homo sapiens; identical to SEQ ID NO: 452329
  misc_feature: HEFZJCU01BLT5C.51.29.C07.1.454.heavy.3.raw

SEQ ID NO: 455389 - DNA, 310 bp, Homo sapiens; identical to SEQ ID NO: 444473
  misc_feature: HEFZJCU01BC6VF.18.53.E09.1.454.heavy.3.raw

SEQ ID NO: 455390 - DNA, 477 bp, Homo sapiens; identical to SEQ ID NO: 444659
  misc_feature: HEFZJCU01BE7FN.16.10.A10.1.454.heavy.3.raw

SEQ ID NO: 455391 - DNA, 528 bp, Homo sapiens
  misc_feature: HEFZJCU01AK1MF.13.62.F07.1.454.heavy.3.raw
tcacgtactacacgaccggtgctcgatttagtagtcgcataaagggaaagggtctgtgcaggcttcagcagtcctggacctcccgtgcaagaacatgaaacacctgtggttcttcctcctgctggtgtcagctcccagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccagggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaacgtccgaagtcgttatcactttgactcgtgggccagggaaccctggt

SEQ ID NO: 455392 - DNA, 507 bp, Homo sapiens
  misc_feature: HEFZJCU01CDSJE.12.79.H02.1.454.heavy.3.raw
atacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaatctcctgcaagtcttctggttacgcactcaccgccaatggtatcagctggctgcgacaggcccctggacaaggtcttgagtggatgtcatggatcagcactttcaatggagacacaaagtatggagagaacttccagggcagagtcaccatgaccactgacagatcaacgaacaatagcctacttggaactgaggggcctgaggtctgacgacacggccctctattattgtgcgagaattaattttcgttattgttctggtggtgtgtgttcaatgtttgaccattc

SEQ ID NO: 455393 - DNA, 430 bp, Homo sapiens
  misc_feature: HEFZJCU01ADDB0.40.34.D01.1.454.heavy.3.raw
tctagcgactcacgaccggtgctcgatttagatcgtctgtgttgggtttgggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttcagcttccaccaagggcccatcggtcttccccctggcgccctgctccaggagcacctccgagagcacagcggccctgggctgcctggtcaaggactacttccagtcgctaga

SEQ ID NO: 455394 - DNA, 471 bp, Homo sapiens
  misc_feature: HEFZJCU01CKVAI.48.51.E07.1.454.heavy.3.raw
agtatacatacacgaccggtgctcgatttagcatactctacaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctacgacaggcccctggacaagggcttgagtggatgggatggatctatcctaccagtggtggcacacgctattcacagaagtttcagggcaggggtcaccatgaccaggggacacgtccatcagcacagcctacatggaattgagcaggctgacatctgacgacacggccgtgtattattgtgcgagag

SEQ ID NO: 455395 - DNA, 522 bp, Homo sapiens
  misc_feature: HEFZJCU01B8QG5.11.12.B01.1.454.heavy.3.raw
cgagagataccacgaccggtgctcgatttagtagtgtagatttgggtctgggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgacgttactacgctatggacgtctggggccaagggtaccg

SEQ ID NO: 455396 - DNA, 496 bp, Homo sapiens; identical to SEQ ID NO: 445094
  misc_feature: HEFZJCU01DGDLV.10.71.G05.1.454.heavy.3.raw

SEQ ID NO: 455397 - DNA, 396 bp, Homo sapiens; identical to SEQ ID NO: 444469
  misc_feature: HEFZJCU01CEJZ3.47.46.E02.1.454.heavy.3.raw

SEQ ID NO: 455398 - DNA, 497 bp, Homo sapiens
  misc_feature: HEFZJCU01CGG1U.51.38.D05.1.454.heavy.3.raw
cgatcgtatacacgaccggtgctcgatttagtatctgatagttgggtttgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 455399 - DNA, 506 bp, Homo sapiens; identical to SEQ ID NO: 444696
  misc_feature: HEFZJCU01B1YYZ.16.34.D01.1.454.heavy.3.raw

SEQ ID NO: 455400 - DNA, 309 bp, Homo sapiens; identical to SEQ ID NO: 444418
  misc_feature: HEFZJCU01AK9J0.18.53.E09.1.454.heavy.3.raw

SEQ ID NO: 455401 - DNA, 498 bp, Homo sapiens
  misc_feature: HEFZJCU01CQ89I.51.78.H01.1.454.heavy.3.raw
cgatcgtatacacgaccggtgctcgatttagtgtgagtagtttgggtttgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccaggggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 455402 - DNA, 515 bp, Homo sapiens
  misc_feature: HEFZJCU01BJ86U.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaagggcccatcggtcttccccctggcaccctcctccaagagcacctctgggggcacagcggccctgggctgcctggttaaggactacttccgtactagacg

SEQ ID NO: 455403 - DNA, 478 bp, Homo sapiens
  misc_feature: HEFZJCU01EROG4.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacacagagtccgtgaagggccgattcaccatctccagagacacttccgagaacacgctgtatcttgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 455404 - DNA, 499 bp, Homo sapiens
  misc_feature: HEFZJCU01AQVTM.17.10.A10.1.454.heavy.3.raw
cgtagactagcacgaccggtgctcgatttagcgtcgatctcagggtacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttc

SEQ ID NO: 455405 - DNA, 520 bp, Homo sapiens
  misc_feature: HEFZJCU01BKUMJ.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactgggggccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 455406 - DNA, 396 bp, Homo sapiens; identical to SEQ ID NO: 444433
  misc_feature: HEFZJCU01DQXZ2.47.59.F04.1.454.heavy.3.raw

SEQ ID NO: 455407 - DNA, 512 bp, Homo sapiens
  misc_feature: HEFZJCU01B4FRB.14.61.F06.1.454.heavy.3.raw
cgtctagtaccacgaccggtgctcgatttagctacgctctaagggaaaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagatgcctggggcctcagttgaggtctcctgcaggacttctggttacacctttaccaactatggtatcacctgggtgcggcaggtcccaggacaagggcttgagtggctgggatggatcagcggtttcgatgagaaaccagttctgcacaaaagttccagggcagactcaccctgactacagacgcatcaacgggctcagccttcatgaccctgaggaacctgagacctgacgacgcggccatctattactgtgcgagagatgggtggcagctcgtctcaggaattgacttcgtgggggcccggaaccctgactc

SEQ ID NO: 455408 - DNA, 396 bp, Homo sapiens; identical to SEQ ID NO: 444469
  misc_feature: HEFZJCU01CCDMM.47.46.E02.1.454.heavy.3.raw

SEQ ID NO: 455409 - DNA, 506 bp, Homo sapiens; identical to SEQ ID NO: 444696
  misc_feature: HEFZJCU01C9228.16.34.D01.1.454.heavy.3.raw

SEQ ID NO: 455410 - DNA, 512 bp, Homo sapiens
  misc_feature: HEFZJCU01B6PJB.53.61.F06.1.454.heavy.3.raw
cgcgtatacacacgaccggtgctcgatttagctacgctctaagggaaaggggtcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcaccatctcgagagacaattccaggaacacgctgtatctgcaaatgaacggcctgagagctgaggacacggctgtgtattactgtgcgaaacggtttgagtgggaagttaggggctgagtacggtatggacgtcgtggggccaagggaccacggtcaccgtctcctc

SEQ ID NO: 455411 - DNA, 498 bp, Homo sapiens
  misc_feature: HEFZJCU01BEJOU.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgacctttttctggtatttcgatctctggggccgtggcaccctggtcactgtctcctcggcttccaccaagggcccatcggtcttcccctggcgccctgctccaggagcacctctgggggcacagcggccctgggctgcctggtcaaggactacttcctacgtcgtat

SEQ ID NO: 455412 - DNA, 508 bp, Homo sapiens
  misc_feature: HEFZJCU01DDNXP.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtcctactttgactactgggccagggactctggtcaccgtctccgcagcctccaccaaggcc

SEQ ID NO: 455413 - DNA, 507 bp, Homo sapiens
  misc_feature: HEFZJCU01DX9OX.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttccccctggcgccctgctccaggagcacctcccgagagcacagcggccctgggctgcctggtcaaggactacttcctatgtatact

SEQ ID NO: 455414 - DNA, 510 bp, Homo sapiens; identical to SEQ ID NO: 454892
  misc_feature: HEFZJCU01D04Z4.17.33.C11.1.454.heavy.3.raw

SEQ ID NO: 455415 - DNA, 508 bp, Homo sapiens; identical to SEQ ID NO: 444619
  misc_feature: HEFZJCU01APXI8.3.81.H04.1.454.heavy.3.raw

SEQ ID NO: 455416 - DNA, 324 bp, Homo sapiens; identical to SEQ ID NO: 444475
  misc_feature: HEFZJCU01CL8WD.18.17.B06.1.454.heavy.3.raw

SEQ ID NO: 455417 - DNA, 523 bp, Homo sapiens
  misc_feature: HEFZJCU01EJPFS.3.55.E11.1.454.heavy.3.raw
  modified_base (478)..(478): a, c, t, g, unknown or other
agacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgatggaagaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccagggaaccctggtcaccgtctcctcagcctccnccaagggcccatcggtcttccccctggccaccctcctccaagacg

SEQ ID NO: 455418 - DNA, 510 bp, Homo sapiens
  misc_feature: HEFZJCU01EQL00.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagccaagacagattttggagtggttactgttggactactttgactactggggccaggggaacctggt

SEQ ID NO: 455419 - DNA, 516 bp, Homo sapiens
  misc_feature: HEFZJCU01ESM1D.22.73.G07.1.454.heavy.3.raw
acatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtccccagggaagggactggagtggattgggtatatctattacactgggagcaccgactacagcccctccctcatgagtcgagtcaccatttcactagacacgtccaagaaccagttctccctgaaactgaggtctgtgaccgctgcggacacgaccgtctattactgtgcgagatttgctttttggagtggttacgccgcgtttgactactggggccagggaaccctggtcaccgtctcctcagcctccaccaac

SEQ ID NO: 455420 - DNA, 519 bp, Homo sapiens
  misc_feature: HEFZJCU01AQPFB.13.87.H10.1.454.heavy.3.raw
tcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgttgcaaaagataccaaccccttacgtactttttggagttggtttaacg

SEQ ID NO: 455421 - DNA, 505 bp, Homo sapiens
  misc_feature: HEFZJCU01EMKIY.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccaacgagcacagcctacatggagctggaggagcctgagatctgacgacacggccgtgtattactgtgcgaggtaggttttagtgattacttattgtagtggtggtacctgtcttacgtttttcc

SEQ ID NO: 455422 - DNA, 505 bp, Homo sapiens
  misc_feature: HEFZJCU01D81RH.51.36.D03.1.454.heavy.3.raw
cgatcgtatacacgaccggtgctcgatttagctgcgtcacgatctctcttggggatgctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcagccccccgggaaggggctggattggattggcagtatcagttatactgggaccaccttcttcaagtcgtcgctcaagagtcgagtcaccatgaccgcggacacgtccaaggaccagttctccctgaagctgacctctgtgaccgccgcagacacggctttgtatttctgtgctagatataatgtgggtgacagtggtgcctactacggagtcttttgattagtttggggccaaggc

SEQ ID NO: 455423 - DNA, 528 bp, Homo sapiens
  misc_feature: HEFZJCU01DUTZF.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggccaggggaccctggtcatcgtctccccagcctccaccaagggcccatcggtcttccccctggccgccctcg

SEQ ID NO: 455424 - DNA, 480 bp, Homo sapiens
  misc_feature: HEFZJCU01BVVTA.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttcccctggcaccctcctccaagagcacctctggggcacagcggccctgggctgcctggtcaaggactacttcctagagacacg

SEQ ID NO: 455425 - DNA, 372 bp, Homo sapiens; identical to SEQ ID NO: 444578
  misc_feature: HEFZJCU01EGO5F.49.68.G02.1.454.heavy.3.raw

SEQ ID NO: 455426 - DNA, 525 bp, Homo sapiens
  misc_feature: HEFZJCU01DPWTF.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagtaatctggagctgaacagcctgtcatctgaggacacgggcttctacttctgtgcgaggagtaattactataacactgctccttttacactcccttgacttctggggcatggaacccggtcaccgt

SEQ ID NO: 455427 - DNA, 524 bp, Homo sapiens; identical to SEQ ID NO: 446401
  misc_feature: HEFZJCU01AGVXH.3.82.H05.1.454.heavy.3.raw

SEQ ID NO: 455428 - DNA, 507 bp, Homo sapiens
  misc_feature: HEFZJCU01CKH4V.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttccccctggcaccctcctccaagagcacctctgggggcacagcggccctgggctgcctggtcaaggactacttcctagtacgtga

SEQ ID NO: 455429 - DNA, 526 bp, Homo sapiens
  misc_feature: HEFZJCU01CBZKF.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctgggccagggaacccaggtcaccgtctcctcagcctccaccaagggcccatccgtcttccccctcgcgccctgcctccaggagcacctccgagacgcacagcggccctcgggctgcctggtcaaggactaccttcctaccg

SEQ ID NO: 455430 - DNA, 504 bp, Homo sapiens
  misc_feature: HEFZJCU01C9LYK.16.37.D04.1.454.heavy.3.raw
tgtactactccacgaccggtgctcgatttagtagcatactgtgggtttgggggagacttagtacagccggggggtccctgagactctcctgtgcagcctctggattcacctttagtgcctatgccatgagctgggtacgccaggctccagggaaggggctagaatgggtctcaagtatcacaagcagtagtagtaccgcatggtacgcagactccgtgaagggccgtttcaccatctccagagacaattccaagaacacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggccctgggctgcctggtcaaggactacttccgagtagtaca

SEQ ID NO: 455431 - DNA, 348 bp, Homo sapiens
  misc_feature: HEFZJCU01BSECB.8.12.B01.1.454.heavy.3.raw
ctcgcgtgtccacgaccggtgctcgatttagtagtgtagatttggtgggacaacagattacgccgcgtctgtgaaaggcagattcaccatctcaagagatgattccaaaagcatcgcctttctacaaattgacagcctgaaaaccgaggacacaggcgtgtattactgcaacaggtttggttcgggaaatccgcaaaatgacctctggggccagggaaccctggtcaccgtctcctcagcctccaccaagggcccatcggtcttccccctggcgccctgctccaggagcacctccgagagcacagcggccctgggctgcctggtcaaggactacttccgacacgcgag

SEQ ID NO: 455432 - DNA, 516 bp, Homo sapiens
  misc_feature: HEFZJCU01DGL1V.48.37.D04.1.454.heavy.3.raw
agtatacatacacgaccggtgctcgatttagtagcatactgttgggtttggggggaagaggaagactgacggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctcgctccaggagcacctccgagagcacagcggccgtgggctgcctggtcaaggactacttcctatgta

SEQ ID NO: 455433 - DNA, 515 bp, Homo sapiens
  misc_feature: HEFZJCU01ELH3L.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctaggaatagaacaatctgagagtcgacgatacggctgtctatcattgtgttttcgatgccttcggtccgcgggacttcgtggggccagggtaacccg

SEQ ID NO: 455434 - DNA, 513 bp, Homo sapiens
  misc_feature: HEFZJCU01EDPY9.13.36.D03.1.454.heavy.3.raw
tcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctctggtgggttcttcagtggttactactggagctggatccgccagtccccagggaaggggctggagtggattggggaaatcaatcatagtggaagcaccaactacaacccgtccctcgagagccgagtcaccatgtcagtagacacgtccaagaaccagttctccctgagggtgagctctgtgaccgccgcggacacggctgtgtacttctgtgcgagaggcaatttttggactcgtcattctccctttgacttctggggccagggaaccctagtcaccgtc

SEQ ID NO: 455435 - DNA, 406 bp, Homo sapiens
  misc_feature: HEFZJCU01BPFY7.16.28.C06.1.454.heavy.3.raw
tgtactactccacgaccggtgctcgatttagagctcacgtattgggtttgggattgtctctggagtgggtctcacttattagtggtagtggtagtactacatactacgcagactccgtgaagggccggttcaccatctccagagacaatcccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttccccctggcaccctcctccaagagcacctctgggggcacagcggccctgggctgcctggtcaaggactacttccgagtagtaca

SEQ ID NO: 455436 - DNA, 514 bp, Homo sapiens
  misc_feature: HEFZJCU01DASPU.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacgggccgtgtattactgtgcgaggtcgattgtgatggtaacaactgcttcttactcctttgaccagtgggccggggaaccctggtcaccgtctcttcagcctccaccaaggcccatcggtcttccctggcaccctcctccaagagcacctctcgggggcac

SEQ ID NO: 455437 - DNA, 394 bp, Homo sapiens
  misc_feature: HEFZJCU01BPT1S.16.72.G06.1.454.heavy.3.raw
tgtactactccacgaccggtgctcgatttagctacgactgcaagggaaaggggctggagtgggtctcatctattagtagtagtgatagtgccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 455438 - DNA, 516 bp, Homo sapiens
  misc_feature: HEFZJCU01D3IU5.26.12.B01.1.454.heavy.3.raw
agactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccaggggaggggcctggagtgggtctcaggtatcagttacaatagtggtaatatactctatgcggactctgtgaagggccgattcaccatctccagagacaacgccaggaactccctctatctagaaatggacagtctgacaactgaggacacggccttttattctgtgcaaagggtggaaccgacatatttcacaagctggcactggtacttcg

SEQ ID NO: 455439 - DNA, 495 bp, Homo sapiens
  misc_feature: HEFZJCU01BQ6SB.51.25.C03.1.454.heavy.3.raw
cgatcgtatacacgaccggtgctcgatttagtagtgtagatttgggtttgggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 455440 - DNA, 481 bp, Homo sapiens; identical to SEQ ID NO: 445006
  misc_feature: HEFZJCU01CIOGJ.7.10.A10.1.454.heavy.3.raw

SEQ ID NO: 455441 - DNA, 428 bp, Homo sapiens
  misc_feature: HEFZJCU01CJ4L7.11.26.C04.1.454.heavy.3.raw
cgagagataccacgaccggtgctcgatttagtctagcgactttgggtttggggggaagaggaagactgacggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtcccctggctggcacctgtatccgaccgttggagtcagggaactctggtcaccgtctcctcagcctccaccaagggcccatcggtcttccccctggcgccctgctccaggagcacctccgagagcacagcggccctgggctgcctggtcaaggactacttccgtatctctcg

SEQ ID NO: 455442 - DNA, 510 bp, Homo sapiens
  misc_feature: HEFZJCU01EI5QN.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccgggtgagccctacggcaggcggtcctttgacctttcgtc

SEQ ID NO: 455443 - DNA, 489 bp, Homo sapiens
  misc_feature: HEFZJCU01B6E85.14.55.E11.1.454.heavy.3.raw
cgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtggtg

SEQ ID NO: 455444 - DNA, 521 bp, Homo sapiens; identical to SEQ ID NO: 447111
  misc_feature: HEFZJCU01CCS4A.16.86.H09.1.454.heavy.3.raw

SEQ ID NO: 455445 - DNA, 490 bp, Homo sapiens
  misc_feature: HEFZJCU01APA51.48.20.B09.1.454.heavy.3.raw
agtatacatacacgaccggtgctcgatttagtgtagtgtgaagggggggcctggtaccgcctggggggtcccttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 455446 - DNA, 489 bp, Homo sapiens
  misc_feature: HEFZJCU01BXUX4.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctggctgcctggtcaaggactactccgtatctctcg

SEQ ID NO: 455447 - DNA, 443 bp, Homo sapiens; identical to SEQ ID NO: 446583
  misc_feature: HEFZJCU01A02Q6.10.11.A11.1.454.heavy.3.raw

SEQ ID NO: 455448 - DNA, 394 bp, Homo sapiens
  misc_feature: HEFZJCU01ARSFF.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaggactacttccgagtagtaca

SEQ ID NO: 455449 - DNA, 492 bp, Homo sapiens
  misc_feature: HEFZJCU01AOX55.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgcctccaggagcacctccgagagcacagcggccctgggctgcctggtcaaggactacttcccacgagagta

SEQ ID NO: 455450 - DNA, 509 bp, Homo sapiens; identical to SEQ ID NO: 444586
  misc_feature: HEFZJCU01DZ38I.12.78.H01.1.454.heavy.3.raw

SEQ ID NO: 455451 - DNA, 514 bp, Homo sapiens; identical to SEQ ID NO: 453195
  misc_feature: HEFZJCU01EJQZN.12.25.C03.1.454.heavy.3.raw

SEQ ID NO: 455452 - DNA, 512 bp, Homo sapiens
  misc_feature: HEFZJCU01DRMSI.48.22.B11.1.454.heavy.3.raw
agtatacatacacgaccggtgctcgatttagacgacagctcaggggctgggagaggagctccagccttgggattcccagctgtctccactcggtgatcggcactgaatacaggagactcaccatggagtttgggctgaactgggttttccttgttgctattttaaaaggtgtccagtgtgaggtgcagctggtggagtccgggggagccttggttcagcctggggggtctctgaaactctcctgtgcagcctctgggttcatgttcaatgtctctgctattcactgggtccgccaggcttccgggaaagggctggaatgggttggtcgtattagaactaaagtaaatagttacgcgacagcagatgctgcgtcggtgaaaggcaggttcaccatctccagagatgattcaaagaacacggcgtatctgcaaatgaacagcctgaaaaccgaggacacggccatttatttttgtgctagatctgaagaattaccagctgctgtgttctccccc

SEQ ID NO: 455453 - DNA, 512 bp, Homo sapiens
  misc_feature: HEFZJCU01EMMSI.3.34.D01.1.454.heavy.3.raw
agacgcactccacgaccggtgctcgatttagatcgtctgtgttgggtttgggggagacctggttgagcctgggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggactacttccgagtgcgtct

SEQ ID NO: 455454 - DNA, 539 bp, Homo sapiens
  misc_feature: HEFZJCU01EXGDV.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagcgtggcgttttcttagtggctattttaaaaggtgtccagtgtgaggtgcagttggtggactctgggggagacctgataccgcctggggggtccctgagactctcctgtacagcctctggatttcaccttttaggagccatgccatgagctgggtccgccaggctccagggaaggggctggagtgggtctctactattactgctagtggtaatcatgcatactatgcagactccgtgaagggccggttcaccttcaccagagacaattccaagaacacgctctatctgcaattgaccagcctgagcgccgaggacgacggccatgtattactgtactaaatcgcgggtggccggcggccggtaccgtcggagttggtttgtagtttctggggtccaagggaacg

SEQ ID NO: 455455 - DNA, 518 bp, Homo sapiens
  misc_feature: HEFZJCU01CMK7K.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaaggcccatcgtctcccctggcg

SEQ ID NO: 455456 - DNA, 393 bp, Homo sapiens; identical to SEQ ID NO: 444509
  misc_feature: HEFZJCU01B1XSY.49.46.E02.1.454.heavy.3.raw

SEQ ID NO: 455457 - DNA, 524 bp, Homo sapiens
  misc_feature: HEFZJCU01DCTJ3.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggtagtacatactccgcagactccgtgaggggccgattcaccatctccagagacaattccaagaacacgctgttctcaaatgaacagcctgagagccgatgacacggccgtgtattactgtgcggagagtgggtccgaccgaacgttactaacgtcgtactaggtacggtctgggtcggaacc

SEQ ID NO: 455458 - DNA, 502 bp, Homo sapiens
  misc_feature: HEFZJCU01ERPIB.9.30.C08.1.454.heavy.3.raw
tgatacgtctcacgaccggtgctcgatttagtctgacgtcaaagggaaagggtctgtgaagccttcacagaccctgtccctcacctgcactgtctctggtgactccatcaccggtactaattactactggagttggatccgccagtcccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcagcctccaccaagggcccatcggtcttccccctggccgccctgctccaggagcacctccgagagcacagcgcccgtgggctgcctggtcaaggactacttccagacgtatca

SEQ ID NO: 455459 - DNA, 540 bp, Homo sapiens
  misc_feature: HEFZJCU01EB2EA.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccggggggaggcttggtacagccgggggggtccctgacactctcctgtgcagcctcaggattcatttttagcgaatatgccatgagctgggtccgccaggctccagggaaggggctggagtgggtctcagcaatcagtggttctaggtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggccgtttcatgtctggggccaagggacgctggtcaccgtctcttcagcctccaccaagggcccatcggtcttcccctggcaccctcctccaagagcacctctgggggcacagcc

SEQ ID NO: 455460 - DNA, 530 bp, Homo sapiens
  misc_feature: HEFZJCU01D8JUH.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagaggggacggactacgggtgactactgggggttcgaccccgtggggccagggaaccctggtcaccgtctcctcagcctccaaccg

SEQ ID NO: 455461 - DNA, 483 bp, Homo sapiens
  misc_feature: HEFZJCU01BHS8S.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtccttcccctggcaccctcctccaagagcacctctggggcacagcggccctgggctgcctggtcaaggactacttccgtatctctcg

SEQ ID NO: 455462 - DNA, 506 bp, Homo sapiens
  misc_feature: HEFZJCU01CEIE4.48.81.H04.1.454.heavy.3.raw
  modified_base (483)..(483): a, c, t, g, unknown or other
agtatacatacacgaccggtgctcgatttagtagtgtagattcgcgggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagaaccgtgacgacacggccattactactgtgcgcggggagtggacggagctcggtttcggngttatcatctactctttgaattc

SEQ ID NO: 455463 - DNA, 490 bp, Homo sapiens
  misc_feature: HEFZJCU01CQ4R9.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgcctgctccaggagcacctccgagagcacagcggccctgggctgcctggtcaaggactacttccgtatctctcg

SEQ ID NO: 455464 - DNA, 496 bp, Homo sapiens; identical to SEQ ID NO: 451074
  misc_feature: HEFZJCU01B62GK.4.87.H10.1.454.heavy.3.raw

SEQ ID NO: 455465 - DNA, 548 bp, Homo sapiens
  misc_feature: HEFZJCU01AGPYZ.13.40.D07.1.454.heavy.3.raw
tcacgtactacacgaccggtgctcgatttagtgatagagcgtaaaaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaaacgtccgaagtcgttatcactttgactcctggggccagggaaccctggtcagcgtctcttcagcctccaccaagggcccagtcggtcttcccctggcaccctcctccagagcacctctcgggggcacgacgcggccctcgggctgcctggtacg

SEQ ID NO: 455466 - DNA, 515 bp, Homo sapiens
  misc_feature: HEFZJCU01D58ME.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagtaaggtgtccagtgtgaggtgcagctggtggagtctggggggggcgttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggtcgattcatcatctccagagacaacgccgacaactcactgtctctgctgatgagcagcctgagagccgacgacacggctatctattactgtgcgaaactctacattccgttcatctgaatactggggccagggaacccctggtcgcccg

SEQ ID NO: 455467 - DNA, 540 bp, Homo sapiens
  misc_feature: HEFZJCU01DV8M6.52.22.B11.1.454.heavy.3.raw
cgcagtacgacacgaccggtgctcgatttagacgacagctcagggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatgaaaactacgacccctggcgctatggacgtctggggccagggaccacggtcaccgtctcctcagcctccaccaagggcccatcggtcttcccccgtc

SEQ ID NO: 455468 - DNA, 507 bp, Homo sapiens; identical to SEQ ID NO: 446637
  misc_feature: HEFZJCU01B172S.16.34.D01.1.454.heavy.3.raw

SEQ ID NO: 455469 - DNA, 527 bp, Homo sapiens; identical to SEQ ID NO: 446218
  misc_feature: HEFZJCU01D0VMM.9.33.C11.1.454.heavy.3.raw

SEQ ID NO: 455470 - DNA, 491 bp, Homo sapiens; identical to SEQ ID NO: 447981
  misc_feature: HEFZJCU01C3SLW.47.85.H08.1.454.heavy.3.raw

SEQ ID NO: 455471 - DNA, 495 bp, Homo sapiens; identical to SEQ ID NO: 452240
  misc_feature: HEFZJCU01CS8NA.4.19.B08.1.454.heavy.3.raw

SEQ ID NO: 455472 - DNA, 387 bp, Homo sapiens
  misc_feature: HEFZJCU01B171W.12.24.C02.1.454.heavy.3.raw
atacgacgtacacgaccggtgctcgatttagtacagatcgttagggaaaggggctggagtggattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctctttgatatctggggccaagggacaatggtcatcgtctcttcagcctccaccaagggcccatcggtcttcccctggcgccctgctccaggagcacctccgagagcacagcggcctgggctgcctggtcaggactacttcctacgtcgtat

SEQ ID NO: 455473 - DNA, 384 bp, Homo sapiens; identical to SEQ ID NO: 444454
  misc_feature: HEFZJCU01CNV5J.11.61.F06.1.454.heavy.3.raw

SEQ ID NO: 455474 - DNA, 480 bp, Homo sapiens
  misc_feature: HEFZJCU01CV8HO.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctcaccaagggcccatcggtcttcccctggcaccctcctccaagagcacctctgggggcacagcggcctgggctgcctggtcaaggactacttcctagagacacg

SEQ ID NO: 455475 - DNA, 492 bp, Homo sapiens
  misc_feature: HEFZJCU01ETN53.4.28.C06.1.454.heavy.3.raw
  modified_base (486)..(486): a, c, t, g, unknown or other
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccgggaccctggtcaccgtctcctcggcctccaccaagggcccatcggtcttcccctggcgccctgctccaggagcacctccgagacgcacagcggccctgggctgcctggtcaaggactacttccctanagtgct

SEQ ID NO: 455476 - DNA, 525 bp, Homo sapiens; identical to SEQ ID NO: 453584
  misc_feature: HEFZJCU01CS3EP.47.6.A06.1.454.heavy.3.raw

SEQ ID NO: 455477 - DNA, 526 bp, Homo sapiens
  misc_feature: HEFZJCU01D9HSA.9.78.H01.1.454.heavy.3.raw
tgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctgggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttgcctggttattaccttacg

SEQ ID NO: 455478 - DNA, 400 bp, Homo sapiens; identical to SEQ ID NO: 444452
  misc_feature: HEFZJCU01EZBGK.47.24.C02.1.454.heavy.3.raw

SEQ ID NO: 455479 - DNA, 515 bp, Homo sapiens
  misc_feature: HEFZJCU01AWUML.15.23.C01.1.454.heavy.3.raw
tctacgtagccacgaccggtgctcgatttagtacacgtgattagggattgggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgggggaggcctggtccaggccgggggggtccctgagactctcctgtgccgcctctggactcacctttagtagctattggatgagctgggtccgccaggctccagggaaggggctggagtgggtggccaacataaaggaagatggaagtcagaaacactatgtggactctgtgaagggccgattcaccatctccagagacaacgccaagaattcagtgtatctgcaaatgaacagcctgagagccgaggacacggccgtgtattactgtgtgagagacatgacaacggtgataaaccgggaggggtt

SEQ ID NO: 455480 - DNA, 496 bp, Homo sapiens
  misc_feature: HEFZJCU01EB7S0.48.39.D06.1.454.heavy.3.raw
agtatacatacacgaccggtgctcgatttagtgacatctcgcagttctttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgccttgatatgtgggccaagggacaatggt

SEQ ID NO: 455481 - DNA, 489 bp, Homo sapiens
  misc_feature: HEFZJCU01BJ7YK.49.17.B06.1.454.heavy.3.raw
agtcgagagacacgaccggtgctcgatttagtcgatagtgaaggggctgggagacgagcccagcactggaagtcgccggtgtttccattcggtgatcatcactgaacacagaggactcaccatggagtttgggctgagctgggttttcctcgttgctcttttcagaggtgtccagtgttatgtgcagctggtggagtctgggggaggcgtggtccagcctgggaggtccctgagactcgcctgcaaaccgtccggattcaccttcagtaattatgcaatgcactgggtccgccagactccaggcaaggggctgcactgggtggcggccatatcatttgatggaagcaagaaatactatgcagactccgtgagggccgattcaccatctccagagacagttccgatgacacagtgtatctgcaaatgaacagcctgagacctgaggacacggctctcttttactgtgcgccaggaagcagtggctggccg

SEQ ID NO: 455482 - DNA, 507 bp, Homo sapiens
  misc_feature: HEFZJCU01BOCVP.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaacggcccatcggtcttcccctggcaccctcctccaagagcacctctgggggcacagcggccctgggctgcctggtcaaggactacttccgta

SEQ ID NO: 455483 - DNA, 508 bp, Homo sapiens
  misc_feature: HEFZJCU01A1VTK.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtcccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaaggccatcggtctcccctggc

SEQ ID NO: 455484 - DNA, 507 bp, Homo sapiens; identical to SEQ ID NO: 450163
  misc_feature: HEFZJCU01AX6H1.16.21.B10.1.454.heavy.3.raw

SEQ ID NO: 455485 - DNA, 374 bp, Homo sapiens
  misc_feature: HEFZJCU01EGW7C.13.5.A05.1.454.heavy.3.raw
tcacgtactacacgaccggtgctcgatttagatagatagacagggggaggcattagacattacgcagactccgtgaagggccgattcacagtttccagagacaattccaagaatacggtgtttctgcaaatggacagcctgcggggcgacgacacggctaaatattactgtacgagagaccatttccatgactatggtgtctctcccggattttacaagggcatggacgtctggggccaagggactaccgttaccgtcgccgcagcctccaccaagggcccatcggtcttccccctggcgccctgctccaggagcacctccgagagcacagcggccctgggctgcctggtcaaggactacttccgtactagacg

SEQ ID NO: 455486 - DNA, 515 bp, Homo sapiens
  misc_feature: HEFZJCU01CE3Y0.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgaaagtgagttatatgaccgccgcagacacggccgtgtattactgtgcgagagaggccgttattttaggaccagctgttaaaaactcctactacgtctggacgtctggggccaggggacc

SEQ ID NO: 455487 - DNA, 501 bp, Homo sapiens
  misc_feature: HEFZJCU01B8DPL.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacgcagcgcctttgacttctc

SEQ ID NO: 455488 - DNA, 537 bp, Homo sapiens
  misc_feature: HEFZJCU01BNJZE.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctggggcccgggaaccctggtcaccgtctcctcagcctccaccaagggcccatcggtcttccccctggccaccctcctccaagacg

SEQ ID NO: 455489 - DNA, 423 bp, Homo sapiens; identical to SEQ ID NO: 444772
  misc_feature: HEFZJCU01CK847.16.78.H01.1.454.heavy.3.raw

SEQ ID NO: 455490 - DNA, 465 bp, Homo sapiens; identical to SEQ ID NO: 445921
  misc_feature: HEFZJCU01BLAAI.48.34.D01.1.454.heavy.3.raw

SEQ ID NO: 455491 - DNA, 502 bp, Homo sapiens
  misc_feature: HEFZJCU01CUC4Q.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaagggcccatcggtcttccccctggcgccctgctccaggagcacctcccgagagcacagcggccctgggctgcctggtcaaggactacttcctagtacgtga

SEQ ID NO: 455492 - DNA, 531 bp, Homo sapiens
  misc_feature: HEFZJCU01BC6Q7.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattatataaacactgctcctttttacacctcccttgacttctggggcctatcggaaccccggtcc

SEQ ID NO: 455493 - DNA, 506 bp, Homo sapiens
  misc_feature: HEFZJCU01CPG3T.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttccccctcggcaccctcctccaagagcacctctgggggcacagcgccctgggctgcctggtcaaggactacttcctacgtcgtat

SEQ ID NO: 455494 - DNA, 504 bp, Homo sapiens; identical to SEQ ID NO: 454912
  misc_feature: HEFZJCU01A70QA.17.25.C03.1.454.heavy.3.raw

SEQ ID NO: 455495 - DNA, 517 bp, Homo sapiens
  misc_feature: HEFZJCU01D5PEM.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgttcatctgagggcagtgttcaatggtatgcagactccgtgaagggccgattcaccatctccagagacaattccaggaacacaatgtattggaaatgaacagcctaagtcctgagacacggtgtatactactgtacgaagggaggggggaaccgaggcgggagtccgaagtacttccg

SEQ ID NO: 455496 - DNA, 371 bp, Homo sapiens
  misc_feature: HEFZJCU01B5D9Q.48.33.C11.1.454.heavy.3.raw
agtatacatacacgaccggtgctcgatttagagtgagctcgttgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctagctattggggccagggaaccctggtcgccgtctcctcagcctccaccaagggcccatcggtcttccccctggcgccctgctccaggagcacctccgagagcacagcggccctgggctgcctggtcaaggactacttcctatgtatact

SEQ ID NO: 455497 - DNA, 495 bp, Homo sapiens
  misc_feature: HEFZJCU01EB4UX.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacgggccgtatattactgtgcgaaagatttggggaatgaccacgtc

SEQ ID NO: 455498 - DNA, 524 bp, Homo sapiens
  misc_feature: HEFZJCU01DTFY8.15.16.B05.1.454.heavy.3.raw
tctacgtagccacgaccggtgctcgatttagagctcacgtattgggtttgaggtctcagagaggagccttagccctggactccaaggcctttccacttggtgatcagcactgagcacagaggactcaccatggaattggggctgagcgtggtttcgtgtaggctatttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgaagagccgaggacacggctgtatattactgtgtgagagatgttctgcggttgggggccaggggaaccctgggtcctacccgg

SEQ ID NO: 455499 - DNA, 534 bp, Homo sapiens
  misc_feature: HEFZJCU01EXSO8.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatccctgaaagcgtcaactactactactacggtatggacctctggggaccg

SEQ ID NO: 455500 - DNA, 481 bp, Homo sapiens
  misc_feature: HEFZJCU01DH0VG.19.71.G05.1.454.heavy.3.raw
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaattatgcaccatctgttgagagtcgactgacaatcaacgtagacacatcgaagaaccagttctccctgcagctgacctctgtgactcccgaggacacgggtgtatattactgtggaagaggccccatagacatgccacctcgtctctggtgct

SEQ ID NO: 455501 - DNA, 396 bp, Homo sapiens
  misc_feature: HEFZJCU01DF32A.47.45.E01.1.454.heavy.3.raw
agctcacgtacacgaccggtgctcgatttagtgagtcagtaagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 455502 - DNA, 495 bp, Homo sapiens; identical to SEQ ID NO: 454812
  misc_feature: HEFZJCU01BC1SC.16.37.D04.1.454.heavy.3.raw

SEQ ID NO: 455503 - DNA, 500 bp, Homo sapiens; identical to SEQ ID NO: 445080
  misc_feature: HEFZJCU01D0TSL.3.81.H04.1.454.heavy.3.raw

SEQ ID NO: 455504 - DNA, 427 bp, Homo sapiens; identical to SEQ ID NO: 444708
  misc_feature: HEFZJCU01D1B1M.9.34.D01.1.454.heavy.3.raw

SEQ ID NO: 455505 - DNA, 512 bp, Homo sapiens
  misc_feature: HEFZJCU01D8Y5K.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatgttcggggagttattagtccctactttgactactggggccagggaactctggtcaccgtctccgcagcctccaccaagggccc

SEQ ID NO: 455506 - DNA, 429 bp, Homo sapiens; identical to SEQ ID NO: 447944
  misc_feature: HEFZJCU01D8QV7.4.37.D04.1.454.heavy.3.raw

SEQ ID NO: 455507 - DNA, 396 bp, Homo sapiens
  misc_feature: HEFZJCU01BNWSQ.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaagagcacctccgagagcacagcggccctgggctgcctggtcaaggactacttcccatactcgta

SEQ ID NO: 455508 - DNA, 512 bp, Homo sapiens
  misc_feature: HEFZJCU01A00IL.12.25.C03.1.454.heavy.3.raw
atacgacgtacacgaccggtgctcgatttagtagtgtagatttgggtttggggacccaaaaaccacacccctccttgggagaatcccctagatcacagctcctcaccatggactgggcctggagcctccttttcttggtggcagccgcaacaggtgcccactcccaggttcagctggtgcagtctggggctgagatgaagaagcctggggcctcagtaaaggtctcctgcgaggcttctggttacacctttctcaggtatactattgcctgggtgcgacaggcccctggacaagggcttgagtggatgggtggatcaacgtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtct

SEQ ID NO: 455509 - DNA, 489 bp, Homo sapiens; identical to SEQ ID NO: 444591
  misc_feature: HEFZJCU01DB5IP.18.70.G04.1.454.heavy.3.raw

SEQ ID NO: 455510 - DNA, 481 bp, Homo sapiens
  misc_feature: HEFZJCU01CDH8K.52.6.A06.1.454.heavy.3.raw
cgcagtacgacacgaccggtgctcgatttagatctactgacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctggggggggctggtccagcctgggaggtccctgagactctcctgtgcaggctctgcatttcccttcagtaactatgctatcgattgggtccgccaggctccaggcaagggactggagtgggtggcagttatatcagctgatggaggcaataagtattacgcagattctgcgaggggccgattcaccatatccagagacaactcccaagatatgatatatctgcaaatgaacagcctgagacctgaggacacggccatatattattgtgcgtcgagggggc

SEQ ID NO: 455511 - DNA, 515 bp, Homo sapiens
  misc_feature: HEFZJCU01BDXBM.16.2.A02.1.454.heavy.3.raw
  modified_base (509)..(509): a, c, t, g, unknown or other
tgtactactccacgaccggtgctcgatttagactcatctacagggggagagaggagccttagccctggattccaaggcctatccacttggtgatcagcactgaccaccgaggattcaccatggagctggggctccgctgggttttccttgttgctattttagaaggtgtccagagtgaggtgcagctggtggagtttgggggaggcctggtcaagcctggggggtccctgagactctcctgtgcagcctctgaattcatcttcagtatctataacatgaactgggtccgccagactccagggaaggggctggagtgggtcgcatccattagtggtggtaataattacatatactacggagactcaatgaagggccgcttcaccatctccagagacaacgccgaaaactcactgtatctgcagatgaacagcctgagagccgaagacacggctgtgtattactgtgcgagaggtcttactatgttcggggagtttaatataacgaacgtntttcgt

SEQ ID NO: 455512 - DNA, 502 bp, Homo sapiens
  misc_feature: HEFZJCU01CC1EV.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggccctgggctgcctggtcaaggactacttcccacta

SEQ ID NO: 455513 - DNA, 492 bp, Homo sapiens; identical to SEQ ID NO: 452298
  misc_feature: HEFZJCU01AEJLA.11.13.B02.1.454.heavy.3.raw

SEQ ID NO: 455514 - DNA, 490 bp, Homo sapiens; identical to SEQ ID NO: 444521
  misc_feature: HEFZJCU01B3NAN.19.53.E09.1.454.heavy.3.raw

SEQ ID NO: 455515 - DNA, 519 bp, Homo sapiens; identical to SEQ ID NO: 444867
  misc_feature: HEFZJCU01BH7DY.9.34.D01.1.454.heavy.3.raw

SEQ ID NO: 455516 - DNA, 523 bp, Homo sapiens
  misc_feature: HEFZJCU01EG4XT.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccactcggtcttccccctggcg

SEQ ID NO: 455517 - DNA, 520 bp, Homo sapiens
  misc_feature: HEFZJCU01AT7UJ.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtctggggccaagggaccg

SEQ ID NO: 455518 - DNA, 524 bp, Homo sapiens; identical to SEQ ID NO: 445902
  misc_feature: HEFZJCU01CDM03.9.78.H01.1.454.heavy.3.raw

SEQ ID NO: 455519 - DNA, 435 bp, Homo sapiens; identical to SEQ ID NO: 447528
  misc_feature: HEFZJCU01BWACX.9.30.C08.1.454.heavy.3.raw

SEQ ID NO: 455520 - DNA, 540 bp, Homo sapiens
  misc_feature: HEFZJCU01BI6UI.52.73.G07.1.454.heavy.3.raw
cgcagtacgacacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatagaaactacgcccctggcgctatggacgtctggggccaagggaccacggtcaccgtctcctcagcctccaccaacgggcccatcggtcttccccctc

SEQ ID NO: 455521 - DNA, 528 bp, Homo sapiens
  misc_feature: HEFZJCU01CU6RN.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactactggggccagggaaccctggtcacgtctcctcagcctccacca

SEQ ID NO: 455522 - DNA, 396 bp, Homo sapiens
  misc_feature: HEFZJCU01EMUTD.13.70.G04.1.454.heavy.3.raw
tcacgtactacacgaccggtgctcgatttagtgtagtgtgaagggaaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagatccaaccccttacgatttttggagtggttataccgagtggggccagggaaccctggtcatcgtctcctcagcctccaccaagggcccatcggtcttccccctggcaccctcctccaagagcacctctgggggcacagcggccctgggctgcctggtcaaggactacttcctagtacgtga

SEQ ID NO: 455523 - DNA, 504 bp, Homo sapiens
  misc_feature: HEFZJCU01C55T5.14.21.B10.1.454.heavy.3.raw
  modified_base (473)..(473): a, c, t, g, unknown or other
cgtctagtaccacgaccggtgctcgatttagtgtcgtcgcaggagagaggagcccagccctgggattttcaggtgttttcattcggtgatcaggactgaacagagagaactcaccatggagtttgggctgagcgtgcgttttctaggtggctattttaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgccagcctgagagccgaggacacggccgtatattactgtgcgaaacgccaagntttttggagtgttattatacctttgacttcg

SEQ ID NO: 455524 - DNA, 396 bp, Homo sapiens; identical to SEQ ID NO: 444469
  misc_feature: HEFZJCU01B4FW9.47.46.E02.1.454.heavy.3.raw

SEQ ID NO: 455525 - DNA, 521 bp, Homo sapiens
  misc_feature: HEFZJCU01BFUVD.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctcaagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggccaccctcctccaagagcacctctgggggcacagcggccctgggctgcctggtcaaggactacttccgagtagtacac

SEQ ID NO: 455526 - DNA, 521 bp, Homo sapiens
  misc_feature: HEFZJCU01DK9V6.40.37.D04.1.454.heavy.3.raw
tctagcgactcacgaccggtgctcgatttagtagcatactgttgggtttggggtctgagagaggagcccagccctgggattttcaggtgttttcatttggtgatcaggactgaacagagagaactcaccatggagtttgggctgagcgtggcttttcttagtggctattttaaaaggtgtccagtgtgaggtgcagttgttggaatctgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggcaaatattactgtgtgaaggatcaggaagtgggagctgggtaggcctcaatctggggacc

SEQ ID NO: 455527 - DNA, 491 bp, Homo sapiens
  misc_feature: HEFZJCU01ENAPF.51.49.E05.1.454.heavy.3.raw
cgatcgtatacacgaccggtgctcgatttagagcgactagcaacacacaaaggggagctctgggagaggagccccaggcccgggattcccaggtgtttccattcagtgatcagcactgaagacagaagactcatcatggagttctggctgagctgggttctccttgttgccattttaaaagatgtccagtgtgaggtgcggctgatagaatctggggaggcttggtccagcctggggggtccctgagactctcctgttcagcctctggattcaccttcagtaggaatcctatgcactgggtccgccaggctccaaggaagggactggaatatgtttcagctattacttttgatgggagtggcacatcctatgcagactccgtgaagggcagattcaccatgtccagagacaattccaaaaacacgctgtatcttcaaatgagcagtctgagagctgaggacacggctatctattactgtgtgaaagagggt

SEQ ID NO: 455528 - DNA, 519 bp, Homo sapiens; identical to SEQ ID NO: 444867
  misc_feature: HEFZJCU01B76D1.9.34.D01.1.454.heavy.3.raw

SEQ ID NO: 455529 - DNA, 494 bp, Homo sapiens
  misc_feature: HEFZJCU01CQ1YH.52.38.D05.1.454.heavy.3.raw
cgcagtacgacacgaccggtgctcgatttagtatctgatagttgggtttgggggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcacttatatcctatgatggaagcaataagcactacgcagagtccgtgaagggccgattgaccatctccagagacaactcgaagaatacggttcttctacaaatgaacagcctgagagctgaggacacggctatcttttactgtgcgagagggaactcgattacagcacg

SEQ ID NO: 455530 - DNA, 427 bp, Homo sapiens; identical to SEQ ID NO: 444708
  misc_feature: HEFZJCU01BV0F6.9.34.D01.1.454.heavy.3.raw

SEQ ID NO: 455531 - DNA, 493 bp, Homo sapiens
  misc_feature: HEFZJCU01D8YC8.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtct

SEQ ID NO: 455532 - DNA, 524 bp, Homo sapiens; identical to SEQ ID NO: 445728
  misc_feature: HEFZJCU01CUQTB.5.33.C11.1.454.heavy.3.raw

SEQ ID NO: 455533 - DNA, 525 bp, Homo sapiens; identical to SEQ ID NO: 450208
  misc_feature: HEFZJCU01EMW82.3.82.H05.1.454.heavy.3.raw

SEQ ID NO: 455534 - DNA, 499 bp, Homo sapiens
  misc_feature: HEFZJCU01ECEG6.51.85.H08.1.454.heavy.3.raw
cgatcgtatacacgaccggtgctcgatttagtatcactcagtcgcggggagctctgggagaggagaccagcactagaagtcggcggtgtttccattcggtgatcagcactgaacacagaggtctcaccatggagtttgggctgcgctggattttcctcgttgctctttttagaggtgcccagtgtcagatacaactggtggagtcggggggaggcgtggtccagcctggggggtccctgagagtctcgtgtgcagcctctggattcaccttcaggcgttacggcatgaactgggtccgccaggctccaggcaaggggctggagtgggtggctgtcataacatttgatggaactaagaaatattatgcagactccgtgaagggccgattcaccatctccagagacaattcaaaggacaccctatatttagaaatgagcagcctgagacctgcggacacggctgtgtattactgtgcgaaagatgggggaagttatttcta

SEQ ID NO: 455535 - DNA, 530 bp, Homo sapiens; identical to SEQ ID NO: 449026
  misc_feature: HEFZJCU01C5XAK.7.70.G04.1.454.heavy.3.raw

SEQ ID NO: 455536 - DNA, 489 bp, Homo sapiens
  misc_feature: HEFZJCU01DK3IF.49.59.F04.1.454.heavy.3.raw
agtcgagagacacgaccggtgctcgatttagtacacacacttagggattggggctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacagtctgagacgtgaagacacggctgtctattactgtgcgactgagatgtctt

SEQ ID NO: 455537 - DNA, 489 bp, Homo sapiens; identical to SEQ ID NO: 444791
  misc_feature: HEFZJCU01AXJCY.47.85.H08.1.454.heavy.3.raw

SEQ ID NO: 455538 - DNA, 387 bp, Homo sapiens
  misc_feature: HEFZJCU01C85DW.16.24.C02.1.454.heavy.3.raw
tgtactactccacgaccggtgctcgatttagtacagatcgttagggaaggggctggagtgggtctcaagtattagtggtgttggtggtctcacatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 455539 - DNA, 423 bp, Homo sapiens; identical to SEQ ID NO: 444772
  misc_feature: HEFZJCU01A9HZH.16.78.H01.1.454.heavy.3.raw

SEQ ID NO: 455540 - DNA, 500 bp, Homo sapiens
  misc_feature: HEFZJCU01CCSGF.51.83.H06.1.454.heavy.3.raw
cgatcgtatacacgaccggtgctcgatttagatcacgtgcgtcgcggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggactctgggggaggcgtggtccagcctgggaggtccctgcgactctcctgtgcagcctctggattcagcttcagggctaatactatgttctgggtgcgccaggctccaggcaaggggctggagtgggtggcagtcatctggcctgatggaggtttaacatactatgcggactccgtggagggccgattcaccgtctccagagacaactccaaaaacacgctgtatctccaaatgaacagcctcagatctgaggacacggctatctactactgtgtgaaagaattgggtttcagtggcttacttt

SEQ ID NO: 455541 - DNA, 508 bp, Homo sapiens; identical to SEQ ID NO: 450456
  misc_feature: HEFZJCU01BGA1Q.12.78.H01.1.454.heavy.3.raw

SEQ ID NO: 455542 - DNA, 338 bp, Homo sapiens
  misc_feature: HEFZJCU01EGFXM.48.72.G06.1.454.heavy.3.raw
agtatacatacacgaccggtgctcgatttagctacgactgcaagggaaagggcagagtcacgattaccgcggacaaatccacgagcacagcctacatggagctgagcagcctgagatctgaggacacggccgtgtattactgtgcgagagatcagagtggttattatctccgtgggtactactacggtatggacgtctggggccaagggaccacggtcaccgtctcctcagcctccaccaagggcccatcggtcttcccctggcaccctcctccaagagcacctctggggcacagcggccctgggctgcctggtcaaggactacttcctatgtatact

SEQ ID NO: 455543 - DNA, 517 bp, Homo sapiens
  misc_feature: HEFZJCU01EX6RD.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccaggcgggagttccaagtactcc

SEQ ID NO: 455544 - DNA, 497 bp, Homo sapiens
  misc_feature: HEFZJCU01A2KIW.3.55.E11.1.454.heavy.3.raw
agacgcactccacgaccggtgctcgatttagcactcgcacgttgggtttgggattcacgttgcagatgtaggtccctgagactctcctgtgcagcctctggattcaccttcagtagatatgctatgtattgggtccgtcaggctccaggcaaggggctggagtgggtggcagttatgtcacatgatggaagaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccagggaaccctggtcaccgtctcctcagcctccaccaagggccatcggtcttcccctggcaccctcctccaagagcacctctgggggcacagcggccctgggctgcctggtcaggactacttccga

SEQ ID NO: 455545 - DNA, 515 bp, Homo sapiens; identical to SEQ ID NO: 446186
  misc_feature: HEFZJCU01DZ8FW.9.70.G04.1.454.heavy.3.raw

SEQ ID NO: 455546 - DNA, 484 bp, Homo sapiens; identical to SEQ ID NO: 446564
  misc_feature: HEFZJCU01DYO7T.19.13.B02.1.454.heavy.3.raw

SEQ ID NO: 455547 - DNA, 490 bp, Homo sapiens
  misc_feature: HEFZJCU01DGQKB.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttccccctggcgccctgctccaggagcacctccgagagcacagcggccctgggctgcctggtcaaggactacttcccatactcgta

SEQ ID NO: 455548 - DNA, 542 bp, Homo sapiens
  misc_feature: HEFZJCU01CD9AA.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagcgtggcgttttcttggtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatagtaatgaaaggggtgataacacatactatgcggactctggtaaggggccgggttcaccatctccagagacaattccaagaaaacactgtatctgcaattaaccagcctgagagtcgaggacacggccctttattactgtgcgaaggatcgccctataatggtggctggatcggggagtttggttcctggggccagggaaccctgggt

SEQ ID NO: 455549 - DNA, 505 bp, Homo sapiens; identical to SEQ ID NO: 447076
  misc_feature: HEFZJCU01AZFC3.10.38.D05.1.454.heavy.3.raw

SEQ ID NO: 455550 - DNA, 520 bp, Homo sapiens
  misc_feature: HEFZJCU01BPK71.48.8.A08.1.454.heavy.3.raw
agtatacatacacgaccggtgctcgatttagcatactctacagggggagtctccctcactgcccagctgggatctcagggcttcattttctgtcctccaccatcatggggtcaaccgccatcctcgccctcctcctggctgttctccaaggagtctgcgcggaagtgcgcctggtgcagtctggagcagtggtgaagaggcccggggagtctctaaagatctcctgtcagggttctgaaggcgactttgacaccttctgggtcgcctgggtgcgccagaggcccggtaaaggactagagtatatgggcgtcatctatcctggtgactccgataccatatatactccgtcgtttcaaggccaggtcaccatgtctgccgacaagtccaagactgtcgcctacctccactgggccaactgacgtcctccgacagcgccacttattactgtgcgagggtaggcactacgtcttggggtcgagaggacaactggttcgacccgtcggggccagggaaccctggt

SEQ ID NO: 455551 - DNA, 486 bp, Homo sapiens
  misc_feature: HEFZJCU01CF08N.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctggtcaaggactactcctacgtgagct

SEQ ID NO: 455552 - DNA, 509 bp, Homo sapiens; identical to SEQ ID NO: 447671
  misc_feature: HEFZJCU01EBPCJ.52.78.H01.1.454.heavy.3.raw

SEQ ID NO: 455553 - DNA, 509 bp, Homo sapiens
  misc_feature: HEFZJCU01C70KZ.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggg

SEQ ID NO: 455554 - DNA, 542 bp, Homo sapiens
  misc_feature: HEFZJCU01D81EM.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaaacgtccgaagtcgttatcactttgactcctggggccagggaaccctggtcagcgtctcttcagcctccaccaacgggcccatcggtcttcccctggccaccctcctccaagagcacctctgggggcacagcggccctgggcctgcctc

SEQ ID NO: 455555 - DNA, 502 bp, Homo sapiens
  misc_feature: HEFZJCU01DY75L.53.33.C11.1.454.heavy.3.raw
cgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaaggccatcgtcttcccctgcgcc

SEQ ID NO: 455556 - DNA, 537 bp, Homo sapiens
  misc_feature: HEFZJCU01CJILV.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcacgtctcttcagcctccaccaagggcccatcggtcttcccctggcaccctcctccaagagcacctctggggggcacagcc

SEQ ID NO: 455557 - DNA, 396 bp, Homo sapiens; identical to SEQ ID NO: 444469
  misc_feature: HEFZJCU01C8H98.47.46.E02.1.454.heavy.3.raw

SEQ ID NO: 455558 - DNA, 516 bp, Homo sapiens
  misc_feature: HEFZJCU01D75YG.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgtgctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtta

SEQ ID NO: 455559 - DNA, 400 bp, Homo sapiens; identical to SEQ ID NO: 444452
  misc_feature: HEFZJCU01CMV24.47.24.C02.1.454.heavy.3.raw

SEQ ID NO: 455560 - DNA, 523 bp, Homo sapiens
  misc_feature: HEFZJCU01EH3QN.13.76.G10.1.454.heavy.3.raw
  modified_base (291)..(291): a, c, t, g, unknown or other
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccnccaggctccagggaaggggctggagtgcgtctcttttattatagtagtggtagtacatactccgcagacctccgtgacggggccgattcaccatcctccagagacaattccaagaacacgctgtttcttcaaatgaacagcctgagagccgatgacacggccgtgtattactgtgcgagagagtggggcccacggaacgttactaacgctatggaacggtctgggggacccg

SEQ ID NO: 455561 - DNA, 523 bp, Homo sapiens
  misc_feature: HEFZJCU01ACQ3P.49.81.H04.1.454.heavy.3.raw
agtcgagagacacgaccggtgctcgatttagtagtgtagattcgcgggggggagaggaacccagcactagaagtcggcggtgtttccattcggtgatcaacactgaacacagaggactcaccatggagtttgggctgagcgtggtttccgtcgttaggctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttattactgtgcgaacttaatcacggaggacaagggtgacccccgtccacctcggtacggtacg

SEQ ID NO: 455562 - DNA, 514 bp, Homo sapiens
  misc_feature: HEFZJCU01EWEDI.53.61.F06.1.454.heavy.3.raw
cgcgtatacacacgaccggtgctcgatttagctacgctctaagggaaaggggtcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcaccatctcgagagacaattccaggaacacgctgtatctgcaaatgaacggcctgagagctgaggacacggctgtgtattactgtgcgtaaacggttgagtgggaagttaggggctgagtacggtagtggacgtcgtggggccgaagggaccgacggtcaccgtctcct

SEQ ID NO: 455563 - DNA, 495 bp, Homo sapiens
  misc_feature: HEFZJCU01CS413.51.35.D02.1.454.heavy.3.raw
cgatcgtatacacgaccggtgctcgatttagcacacgatagttgggtttgggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 455564 - DNA, 493 bp, Homo sapiens
  misc_feature: HEFZJCU01CDTG7.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtctcccctggcgccctgctccaggagcacctccgagagcacagcggccctgggctgcctggtcaaggactacttcctacagtgct

SEQ ID NO: 455565 - DNA, 523 bp, Homo sapiens; identical to SEQ ID NO: 446270
  misc_feature: HEFZJCU01EJVDA.12.40.D07.1.454.heavy.3.raw

SEQ ID NO: 455566 - DNA, 490 bp, Homo sapiens
  misc_feature: HEFZJCU01CPSDZ.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttccccctggcgccctcgctccaggagcacctccgagagcacagcggccctgggctgcctggtcaggactacttcccatactcgta

SEQ ID NO: 455567 - DNA, 487 bp, Homo sapiens; identical to SEQ ID NO: 445077
  misc_feature: HEFZJCU01B5848.47.85.H08.1.454.heavy.3.raw

SEQ ID NO: 455568 - DNA, 521 bp, Homo sapiens
  misc_feature: HEFZJCU01CDZOW.4.66.F11.1.454.heavy.3.raw
agcactgtagcacgaccggtgctcgatttagtcacgcgagaagggggggagaggagcccagccttgggattcccaagtgttttcattcagtgatcaggactgaacacagaggactcaccatggagtttgggctgagctggattttccttactgctattttaaaaggtgtccagtgtgaggtgaaactggtggagtctgggggaggcttgataaagcctggggggtcccttagactctcctgtgcagcctctggattcaccttcagtgacgactggatgaattggatccgccaggctccagggaaggggctggagtgggtcggccatattaagcccaaaactgaacgtggggaaacagactacgctgcacccgtgagaggcagattcaccatttcaagagatgattcaaaagtacactgtatctggaatgaacagcctgagaatcgacgacacagccgtttatactgcagaagagggcactatgtccctggggccagggaaccctggtcaccgtctcctcag

SEQ ID NO: 455569 - DNA, 400 bp, Homo sapiens; identical to SEQ ID NO: 444452
  misc_feature: HEFZJCU01D2SZD.47.24.C02.1.454.heavy.3.raw

SEQ ID NO: 455570 - DNA, 517 bp, Homo sapiens
  misc_feature: HEFZJCU01C1O35.3.55.E11.1.454.heavy.3.raw
agacgcactccacgaccggtgctcgatttagcactcgcacgttgggtttgggctgagctgggttttcctcgttgctcttttaagaggtgtccagtgtcaggtgcagctggtggagtctggggggaggcgtggtccagcctgggaggtccctgagactctcctgtgcagcctctggattcaccttcagtagatatgctatgtattgggtccgtcaggctccaggcaaggggctggagtgggtggcagttatgtcacatgatggaagaaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactgggggccagggaaccctggtcaccgtctcctcagcctccaccaaggccatcggtctcccctggcaccctcctccaa

SEQ ID NO: 455571 - DNA, 522 bp, Homo sapiens; identical to SEQ ID NO: 449550
  misc_feature: HEFZJCU01B97GG.12.40.D07.1.454.heavy.3.raw

SEQ ID NO: 455572 - DNA, 379 bp, Homo sapiens; identical to SEQ ID NO: 444450
  misc_feature: HEFZJCU01BU97O.47.77.G11.1.454.heavy.3.raw

SEQ ID NO: 455573 - DNA, 530 bp, Homo sapiens
  misc_feature: HEFZJCU01CHE1A.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgacttctggggccatcggaaccccggtccg

SEQ ID NO: 455574 - DNA, 520 bp, Homo sapiens
  misc_feature: HEFZJCU01DB6AZ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaatagacagcctgagaccagacgacacggctgtctattattgcgcgagagagacacacgaacctactggccaatactatgggggcttgtctggggccaggggaccctggtcatcgtctccccagcctccaccaagggcccatcggtcttccccctggcg

SEQ ID NO: 455575 - DNA, 395 bp, Homo sapiens; identical to SEQ ID NO: 444517
  misc_feature: HEFZJCU01AC1OD.16.68.G02.1.454.heavy.3.raw

SEQ ID NO: 455576 - DNA, 495 bp, Homo sapiens
  misc_feature: HEFZJCU01DI8WD.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctgcaccctcctccaagagcacctctgggggcacagcggccctgggctgcctggtcaaggactacttccgagtagtaca

SEQ ID NO: 455577 - DNA, 501 bp, Homo sapiens
  misc_feature: HEFZJCU01D4KW3.14.21.B10.1.454.heavy.3.raw
cgtctagtaccacgaccggtgctcgatttagtgtcgtcgcaggagagaggagcccagccctgggattttcaggtgttttcattcggtgatcaggactgaacagagagaactcaccatggagtttgggctgagcgtgtcgtttctaggtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagtattttggagtggttattatacctttg

SEQ ID NO: 455578 - DNA, 523 bp, Homo sapiens
  misc_feature: HEFZJCU01B8CXL.13.33.C11.1.454.heavy.3.raw
  modified_base (454)..(454): a, c, t, g, unknown or other
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaaatntggttcaggggagttcgactactggggccagggaaccctggtcaccgtctcctcagcctccaccaaggg

SEQ ID NO: 455579 - DNA, 517 bp, Homo sapiens
  misc_feature: HEFZJCU01DWXQO.9.34.D01.1.454.heavy.3.raw
tgatacgtctcacgaccggtgctcgatttagatcgtctgtgttgggtttgggggaggcttggtccagcctggggagtccctgcgactctactgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtaagattttcgatccctccgcagtcgacactttgattactggggccgggaaccctggtcgccgtctcctcagcctccaccaagggcccatcggtcttcccctggcgccctgctccaggagcactccgagagcacagcggccctgggctgcctggtcaaggctacttccagacgtatcacg

SEQ ID NO: 455580 - DNA, 519 bp, Homo sapiens
  misc_feature: HEFZJCU01EQMHR.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactactccgagtagtacac

SEQ ID NO: 455581 - DNA, 485 bp, Homo sapiens
  misc_feature: HEFZJCU01A2211.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggctttgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggagccaggggaccctggtcatcgtctccccagcctccaccaagggcccatcggtcttcccctggcgccctgctccaggagcacctccgagagcacagcggccctgggctgcctggtcaaggactacttcctacgtcgtat

SEQ ID NO: 455582 - DNA, 511 bp, Homo sapiens; identical to SEQ ID NO: 445268
  misc_feature: HEFZJCU01C2TJA.48.34.D01.1.454.heavy.3.raw

SEQ ID NO: 455583 - DNA, 466 bp, Homo sapiens
  misc_feature: HEFZJCU01AS46D.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggcccatcggtcttccccctggcgccctgctccaggagcacctccgagagcacagcggccctgggctgcctggtcaaggactacttcccacgacgagta

SEQ ID NO: 455584 - DNA, 509 bp, Homo sapiens
  misc_feature: HEFZJCU01DDV7B.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgataacggctgtctatcattgttgttttcgatgccttcggtccgcgggacttcgtggggccaac

SEQ ID NO: 455585 - DNA, 497 bp, Homo sapiens
  misc_feature: HEFZJCU01CTZKN.51.78.H01.1.454.heavy.3.raw
cgatcgtatacacgaccggtgctcgatttagtgtgagtagtttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacag

SEQ ID NO: 455586 - DNA, 485 bp, Homo sapiens
  misc_feature: HEFZJCU01A9WAN.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtcccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccccataacg

SEQ ID NO: 455587 - DNA, 512 bp, Homo sapiens
  misc_feature: HEFZJCU01CA8R3.49.30.C08.1.454.heavy.3.raw
agtcgagagacacgaccggtgctcgatttagtctgacgtcaaagggaaaggggtctgggagaggagcccagcactgggattccgaggtgtttccattcagtgatctgcactgaacacagaggactcgccatggaatttgggctgagctgggttttccttgttgctattataaaaggtgtccagtgtgaggtgcaactggtgcagtctgggggaggcttggtccagcctgggatttccctgagactctcctgtgcagcctctggagtcaccgtcagcaacaactacatgagctgggtccgccaggctccaggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcacctctcttgagtactggggccagggatcccg

SEQ ID NO: 455588 - DNA, 509 bp, Homo sapiens; identical to SEQ ID NO: 450073
  misc_feature: HEFZJCU01DCBXF.16.21.B10.1.454.heavy.3.raw

SEQ ID NO: 455589 - DNA, 510 bp, Homo sapiens
  misc_feature: HEFZJCU01DQD3V.49.38.D05.1.454.heavy.3.raw
agtcgagagacacgaccggtgctcgatttagtatctgatagttgggtttgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggcccatcggtcttccccctggcgccctgctccaggagcacctctgggggcacgagcggccctgggctgcctggtcaaggactacttcctctctcgta

SEQ ID NO: 455590 - DNA, 424 bp, Homo sapiens
  misc_feature: HEFZJCU01A2A4U.16.78.H01.1.454.heavy.3.raw
tgtactactccacgaccggtgctcgatttagtgtgagtagtttgggtttgggctcaactctcttgtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttccccctggcaccctcctccaacgagcacctctgggggcacagcggccctgggctgcctggtcaaggactacttccgagtagtaca

SEQ ID NO: 455591 - DNA, 518 bp, Homo sapiens
  misc_feature: HEFZJCU01DWOC9.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctggggcacagcggcccgtggctgcctggtcaaggactacttcctagagacacg

SEQ ID NO: 455592 - DNA, 410 bp, Homo sapiens
  misc_feature: HEFZJCU01DHIL0.52.35.D02.1.454.heavy.3.raw
cgcagtacgacacgaccggtgctcgatttagcacacgatagttgggtttgggtccggcagccccccgggaagggcctggagtggattggagatatctactacagcgggggcaccagctacagtccctccctcaagagtcgagttggcatatcaatagacacgtccaagaatcagttctccctgaagctgaaatctatcattgttgcggacacggccgtctattattgtgcgagacatggcagcccatatagtcgctggttcgacccctggggcccgggaatcccggtcaccgtctccccagcttccaccaagggcccatcggtcttccccctggcgccctgctccaggagcacctctgggggcacagcggccctgggctgcctggtcaaggactacttcctatacgatcg

SEQ ID NO: 455593 - DNA, 491 bp, Homo sapiens; identical to SEQ ID NO: 444592
  misc_feature: HEFZJCU01CELNE.11.26.C04.1.454.heavy.3.raw

SEQ ID NO: 455594 - DNA, 511 bp, Homo sapiens
  misc_feature: HEFZJCU01BZHEN.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggtagttttacgtatttttggt

SEQ ID NO: 455595 - DNA, 465 bp, Homo sapiens
  misc_feature: HEFZJCU01D0YJP.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatggaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaattggggccagggaaccctggtctccgtctcgtcagcctccaccaagggcccatcggtcttccccctggcgccctgctccaggagcacctccgagagcacagcggccctgggctgcctggtcaaggactacttcccacgagagta

SEQ ID NO: 455596 - DNA, 503 bp, Homo sapiens
  misc_feature: HEFZJCU01BZRUX.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagctttgatctctggggccaagggacactggtcaccgtctcttcagcctccaccaagggcccatcggtcttcccctggcgccctgctccagg

SEQ ID NO: 455597 - DNA, 512 bp, Homo sapiens
  misc_feature: HEFZJCU01DKS1O.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactggggccagggaacccctggtcgtccg

SEQ ID NO: 455598 - DNA, 525 bp, Homo sapiens
  misc_feature: HEFZJCU01ADDFG.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttactgaccctggggccgggaccctggtcaccgtctccccaccctccaccg

SEQ ID NO: 455599 - DNA, 533 bp, Homo sapiens
  misc_feature: HEFZJCU01E1BUP.48.14.B03.1.454.heavy.3.raw
agtatacatacacgaccggtgctcgatttagtgtgagtagttccgcggggctcagagaggagccttagccctggactccaaggcctttccacttggtgatcagcactgagcacagaggactcaccatggaattggggctgatctgggttttccttgttgctctttttggaggtgtccactgtgaggtgcaactggtggaatctgggggaggcttggtccagcctgggggctctctcagactctcctgtgaaacctctggattcacctttacgactttttggatgggttgggtccgccaggccccagggaaggggctgcagtgggtggccaacacaaatcaaaatggaaacgtggagtactatgcggagtctgtgaagggccgggttcaccatctacagagacaacggcaagaagtacgctgtttctgcaaatgaacagcctgacctccgacgacacggctctctattattgtgtgagagatcctggggaccggccgtcttcgggggccagggaacactggttatcgtctcttc

SEQ ID NO: 455600 - DNA, 500 bp, Homo sapiens; identical to SEQ ID NO: 444529
  misc_feature: HEFZJCU01DD1QU.12.38.D05.1.454.heavy.3.raw

SEQ ID NO: 455601 - DNA, 387 bp, Homo sapiens
  misc_feature: HEFZJCU01B6EFB.7.60.F05.1.454.heavy.3.raw
cgtgtctctacacgaccggtgctcgatttagtacgtcatcagggaaaggggctggagtgggtctcagtgatttatagtagttccagttcatttcacgcagactccgtgaagggccgattcaccatctccagagacatttccaagaacacggtggatcttcagatggacagcctcagagcggaggacacggctgtctattactgtgtgagaggcgccaccgtggggatggaaacgattttcttgtttgtctggggccagggaaccctggtcaccgtctcctcagcctccaccaagggcccatcggtcttccccctggcgccctgctccaggagcacctccgagagcacagcggccctgggctgcctggtcaaggactacttcctagag

SEQ ID NO: 455602 - DNA, 505 bp, Homo sapiens
  misc_feature: HEFZJCU01A41E6.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggttgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtgacgtggtagttccggggggacacatgacaccg

SEQ ID NO: 455603 - DNA, 528 bp, Homo sapiens
  misc_feature: HEFZJCU01EPGT2.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaaggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgaccccgtggggccgagggaaccctggtcaccgtctcctcacgcctccaccg

SEQ ID NO: 455604 - DNA, 516 bp, Homo sapiens; identical to SEQ ID NO: 444527
  misc_feature: HEFZJCU01C1QYO.9.34.D01.1.454.heavy.3.raw

SEQ ID NO: 455605 - DNA, 538 bp, Homo sapiens
  misc_feature: HEFZJCU01AX6MV.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagacgccgacgacacggctatctattactgtgacgaaactctctacttccgttacattcctagtaaacttacggtcgggggaccgaacggggtaaccccgtgggtcccgtccc

SEQ ID NO: 455606 - DNA, 489 bp, Homo sapiens
  misc_feature: HEFZJCU01AMHZT.19.53.E09.1.454.heavy.3.raw
tactctcgtgcacgaccggtgctcgatttagagagagtgtgttgggtttgggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 455607 - DNA, 421 bp, Homo sapiens
  misc_feature: HEFZJCU01EI5F9.16.78.H01.1.454.heavy.3.raw
tgtactactccacgaccggtgctcgatttagtgtgagtagtttgggtttggggcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtctccccctggcaccctcctccaagagcacctctgggggcacagcggccctgggctgcctggtcaaggactacttccgagtagtaca

SEQ ID NO: 455608 - DNA, 510 bp, Homo sapiens
  misc_feature: HEFZJCU01C4XTP.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttggtttggagcttttgacttacgtc

SEQ ID NO: 455609 - DNA, 532 bp, Homo sapiens; identical to SEQ ID NO: 446009
  misc_feature: HEFZJCU01BRL4Z.51.26.C04.1.454.heavy.3.raw

SEQ ID NO: 455610 - DNA, 488 bp, Homo sapiens; identical to SEQ ID NO: 452207
  misc_feature: HEFZJCU01B0BZL.47.85.H08.1.454.heavy.3.raw

SEQ ID NO: 455611 - DNA, 531 bp, Homo sapiens
  misc_feature: HEFZJCU01D8QQJ.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacaccccccaaaaaccaggtggtccttacaatgaccaccatggaccctgtggacacagccacatatttctgtgcacactctataggagcacctggtagtctgccaaactgttcgaccctggggcccggaaccctggtcaccgtctcctcagcctccaccaagggcccatcgtcttcccctc

SEQ ID NO: 455612 - DNA, 411 bp, Homo sapiens; identical to SEQ ID NO: 445580
  misc_feature: HEFZJCU01D2NQB.51.31.C09.1.454.heavy.3.raw

SEQ ID NO: 455613 - DNA, 524 bp, Homo sapiens
  misc_feature: HEFZJCU01BOSQX.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggttaccgtctcctcagcctccaccaagggcccatcggtcttcccctggcgccctgctccaggagcacctccgagagcacagcggccctgggctgcctggtcaaggactacttcc

SEQ ID NO: 455614 - DNA, 526 bp, Homo sapiens
  misc_feature: HEFZJCU01AZ0QU.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgaccctgggccagggaacccaggtcaccgtctcctcagcctccaccaagggcccatccgtcttccccctggccgccctgcctccaggagcacctccgagagcacagccggccctgggcctgcctggtcaaggactacgtccttaccg

SEQ ID NO: 455615 - DNA, 528 bp, Homo sapiens; identical to SEQ ID NO: 452880
  misc_feature: HEFZJCU01B0K8S.9.78.H01.1.454.heavy.3.raw

SEQ ID NO: 455616 - DNA, 499 bp, Homo sapiens
  misc_feature: HEFZJCU01D2EHX.48.9.A09.1.454.heavy.3.raw
agtatacatacacgaccggtgctcgatttagcgagacgcgcagggggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtccctcacgtgcactgtctctggtgactccatcaacaatagtcattactactggggctggatccgccagtccccagggaaggggctggagtggattggaattatctattatagcgggagcacctactataatccgtccctcaagagtcgagtcaccatatccgtagacacatccaagaaccagttctccctgaggctgagccctgtgaccgccgcagacacggctgtctattactgtgcgacccatcgatatcatgactggttgttagggcacgtctggggccaagggaccacggtcaccgtctcct

SEQ ID NO: 455617 - DNA, 498 bp, Homo sapiens
  misc_feature: HEFZJCU01D3TY1.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggccatcggtcttcccctggcgccctgctccaggagcacctccgagagcacagcggccctgggctgcctggtcaaggactactcctacgtcgtat

SEQ ID NO: 455618 - DNA, 521 bp, Homo sapiens
  misc_feature: HEFZJCU01AI3KP.12.40.D07.1.454.heavy.3.raw
atacgacgtacacgaccggtgctcgatttagtgatagagcgtaacaacagagggctcaccatggagtttgggctgagcgtggttttccgtcgttaggctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggccctggtcatcgtctccccagcctccaccaggcccatcggtctcccctggccg

SEQ ID NO: 455619 - DNA, 386 bp, Homo sapiens; identical to SEQ ID NO: 444449
  misc_feature: HEFZJCU01BB4J8.27.46.E02.1.454.heavy.3.raw

SEQ ID NO: 455620 - DNA, 356 bp, Homo sapiens; identical to SEQ ID NO: 444460
  misc_feature: HEFZJCU01ETCQK.47.38.D05.1.454.heavy.3.raw

SEQ ID NO: 455621 - DNA, 436 bp, Homo sapiens
  misc_feature: HEFZJCU01DM9YH.3.21.B10.1.454.heavy.3.raw
agacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagttttgacagctggggccagggaaccctggtcaccgtctcctcagcctccaccaagggcccatcggtcttccccctggcgccctgctccaggagcacctccgagagcacagcggccctggctgcctggtcaaggactacttccgagtgcgtct

SEQ ID NO: 455622 - DNA, 495 bp, Homo sapiens; identical to SEQ ID NO: 452240
  misc_feature: HEFZJCU01A76ZV.4.19.B08.1.454.heavy.3.raw

SEQ ID NO: 455623 - DNA, 489 bp, Homo sapiens; identical to SEQ ID NO: 444591
  misc_feature: HEFZJCU01AZ3RF.18.70.G04.1.454.heavy.3.raw

SEQ ID NO: 455624 - DNA, 489 bp, Homo sapiens
  misc_feature: HEFZJCU01B3WQV.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaattggtgccacaaactatgcacagacttttcagggctgggtcaccatgaccagcgacacatctagcaacacagtctacatggagttgaccagcctgaccgacacggccgtgtatttttgtgtgagagattttcggacaatccagacgacccct

SEQ ID NO: 455625 - DNA, 340 bp, Homo sapiens
  misc_feature: HEFZJCU01AQ9IS.47.38.D05.1.454.heavy.3.raw
agctcacgtacacgaccggtgctcgatttagtatctgatagttgggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcgaaagggaccgacggtcaccgtctcctcagcctccaccaagggcccatcggtcttcccctggcaccctcctccaagagcacctctgggggcacagcggccctgggctgcctggtcaaggactacttcctacgtgagct

SEQ ID NO: 455626 - DNA, 510 bp, Homo sapiens; identical to SEQ ID NO: 445542
  misc_feature: HEFZJCU01D0AC5.16.21.B10.1.454.heavy.3.raw

SEQ ID NO: 455627 - DNA, 512 bp, Homo sapiens
  misc_feature: HEFZJCU01EMK8W.48.73.G07.1.454.heavy.3.raw
agtatacatacacgaccggtgctcgatttagctctacgctcagggcacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccggagtttaacacgccggtcgggagggatattactttgacaactggggccagggaaccctggtcaccgtctcctcagcctccaccaagggcccatcggtcttccccctggccgccctgctccaggagcacctccgag

SEQ ID NO: 455628 - DNA, 531 bp, Homo sapiens
  misc_feature: HEFZJCU01EY4V3.13.10.A10.1.454.heavy.3.raw
tcacgtactacacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtactgggcacagaggactcaccatggagtttgggctgaggtggtttttccttggtgctattttaaaaggtgtccattgtgaagtgcccctggtacaatctgggggaggcttggtcaagccgggggagtccctgagactctcctgtgaagcctcaacattcacttttgctcgtgcctgggtgacctgggtccgccaggctccagggaaggggctggagtggattggccatattaaggacagacctaatggcgcgacagcacactaccttgaatccgtcaaagacagattcatcatctcgagaggtgattccgacaacacggtgtctctccatatgagcagcctagaaaatcgaggacacaggcctatatta

SEQ ID NO: 455629 - DNA, 515 bp, Homo sapiens
  misc_feature: HEFZJCU01CFGHK.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgaggctgtgagcgccgcagacacggccgtgtattactgtgcgagactggccgcaacagactacggtggcaactcctatgcttttgatatctggggccaagggacaatggtcaccgtctcttcagcctccaccaaggcccatcggtcttcccctcggcaccctcctccaacgagcacctctgggggcacagcggcccg

SEQ ID NO: 455630 - DNA, 510 bp, Homo sapiens
  misc_feature: HEFZJCU01DAAKX.51.12.B01.1.454.heavy.3.raw
cgatcgtatacacgaccggtgctcgatttagtagtgtagattccgggggggggcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttgacgacacggccgtctattactgtgcgacagaagcggcggacagaggttcgcttactggttcgaggctcctccccag

SEQ ID NO: 455631 - DNA, 525 bp, Homo sapiens
  misc_feature: HEFZJCU01EU2ZF.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggccgccctgctccaggagcacctccgagagcacagccggcccctgggcg

SEQ ID NO: 455632 - DNA, 408 bp, Homo sapiens
  misc_feature: HEFZJCU01D6YTG.3.41.D08.1.454.heavy.3.raw
agacgcactccacgaccggtgctcgatttagtcacgcgagaaagggaaggggctggaatgggttgcatacatttcaagtagtggttccaccatacattatgcagactctgtgaagggccgattcaccgtctccagagacaacgcccagaactcactgtctctacaaatgaacagcctgagacccgaggacacggctgtttattactgtgcgagagaaacttacgatttttggagtggttattatactccccgggatcttgactactggggccaggggaccctggtcaccgtctcctcagcttccaccaagggcccatcggtcttccccctggcgccctgctccaggagcacctctgggggcaaagcggccctgggctgcctggtcaaggactacttccgagtgcgtct

SEQ ID NO: 455633 - DNA, 526 bp, Homo sapiens
  misc_feature: HEFZJCU01D5CX7.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagcgtggtttcgttgttaggctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaatgaataacctgagagccgaggacacggccatgtaattactgtgtgggcattacttgaccctgggccggggaaccctggtcaccgtctccccaccctccaccg

SEQ ID NO: 455634 - DNA, 526 bp, Homo sapiens
  misc_feature: HEFZJCU01BAUN8.12.39.D06.1.454.heavy.3.raw
  modified_base (377)..(377): a, c, t, g, unknown or other
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagaggggganagtggagtagaacgtaaatacgggaaaccgtttgactttggggccagggaaccctggtcaccgtctcctcagcctccaccaagggcccatcggtcttcccctggcaccctcctccaagagcacctctgggggcacagcggcctgggctg

SEQ ID NO: 455635 - DNA, 520 bp, Homo sapiens
  misc_feature: HEFZJCU01DQF94.12.40.D07.1.454.heavy.3.raw
  modified_base (460)..(460): a, c, t, g, unknown or other
atacgacgtacacgaccggtgctcgatttagtgatagagcgtaacaacagagggctcaccatggagtttgggctgagcgtggtttcgtcgttaggctctttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacgactgtctattattgcgcgagagagacacacgaacctactggccaatactatggggcttgttctggggccnggggaccctggtcatcgtctccccagcctccaccaagggcccatcggtcttcccctggcg

SEQ ID NO: 455636 - DNA, 511 bp, Homo sapiens
  misc_feature: HEFZJCU01A4ORC.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagccaagacagattttggagttggttactgttggactactttgacttactggggccagggaaccctggt

SEQ ID NO: 455637 - DNA, 508 bp, Homo sapiens
  misc_feature: HEFZJCU01D5P7S.8.37.D04.1.454.heavy.3.raw
ctcgcgtgtccacgaccggtgctcgatttagtagcatactgttgggtttgggtgcccaagctgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctacaatcacggagcttttgaattttggggccaagggacaatggtcatagtctcctcagcctccaccaagggcccatcggtcttcccctggcaccctcctccaagagcacctctgggggcacagcggccctggctgcc

SEQ ID NO: 455638 - DNA, 499 bp, Homo sapiens; identical to SEQ ID NO: 450485
  misc_feature: HEFZJCU01DDDFY.11.73.G07.1.454.heavy.3.raw

SEQ ID NO: 455639 - DNA, 379 bp, Homo sapiens; identical to SEQ ID NO: 444450
  misc_feature: HEFZJCU01CXDN4.47.77.G11.1.454.heavy.3.raw

SEQ ID NO: 455640 - DNA, 517 bp, Homo sapiens
  misc_feature: HEFZJCU01BB71K.48.35.D02.1.454.heavy.3.raw
agtatacatacacgaccggtgctcgatttagcacacgatagttgggtttggggggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtggtcgtggcagtggctggtacgtggctctcagtggttcgaccctggggccagggatacctggtcaccgtctcctcagcttccaccaac

SEQ ID NO: 455641 - DNA, 502 bp, Homo sapiens
  misc_feature: HEFZJCU01C1E3L.40.12.B01.1.454.heavy.3.raw
tctagcgactcacgaccggtgctcgatttagtagtgtagattcggcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggaccg

SEQ ID NO: 455642 - DNA, 500 bp, Homo sapiens
  misc_feature: HEFZJCU01A845F.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaaggcccatcggtcttcccctggcgccctgctccaggagcacctccgagagcacagccggccctgggctgcctggtcaaggactacttcctacgtcgtat

SEQ ID NO: 455643 - DNA, 519 bp, Homo sapiens; identical to SEQ ID NO: 444867
  misc_feature: HEFZJCU01BALPI.9.34.D01.1.454.heavy.3.raw

SEQ ID NO: 455644 - DNA, 522 bp, Homo sapiens; identical to SEQ ID NO: 446788
  misc_feature: HEFZJCU01EI18J.12.40.D07.1.454.heavy.3.raw

SEQ ID NO: 455645 - DNA, 498 bp, Homo sapiens
  misc_feature: HEFZJCU01DD195.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtggggtggcgattatatcacatgatggaactaatagacgctatgccgactccgtgaagggtccgattcaccatctccagagacaattccaagaacacgcagtatctgcaaatgaacagcctgagaagctgaggacacgggctgtgtattactggtgggagagatggaggtcgatattgta

SEQ ID NO: 455646 - DNA, 375 bp, Homo sapiens; identical to SEQ ID NO: 444459
  misc_feature: HEFZJCU01ETDIQ.48.59.F04.1.454.heavy.3.raw

SEQ ID NO: 455647 - DNA, 519 bp, Homo sapiens
  misc_feature: HEFZJCU01B7FG5.9.78.H01.1.454.heavy.3.raw
tgatacgtctcacgaccggtgctcgatttagtgtgagtagtttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttatta

SEQ ID NO: 455648 - DNA, 498 bp, Homo sapiens
  misc_feature: HEFZJCU01A3SZ3.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggtgcgtatagacaacctaataatacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 455649 - DNA, 509 bp, Homo sapiens
  misc_feature: HEFZJCU01EHZ9M.12.30.C08.1.454.heavy.3.raw
atacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtccccagggaagggcctggagtggattgggtacatctatcacagtgggagcacctactacatcccgtccctgaagagtcgaattacgatgtcagtaaacacgtctaggaaccagttctccctgaagctgaggtctgtgactgccgcagacacggccgtctactactgtgccaggtgggctttgcgccagtggttcagagatgatcgcttcgattcgtggggaccagggaatttcg

SEQ ID NO: 455650 - DNA, 534 bp, Homo sapiens
  misc_feature: HEFZJCU01DVW9F.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaagggcccatcggtcttccccctggccaccctcctccaagagcacctctc

SEQ ID NO: 455651 - DNA, 477 bp, Homo sapiens
  misc_feature: HEFZJCU01DG9NC.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctcaagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctccgagagcacagcggccctgggctgtctggtcaaggactacttccgagtagtaca

SEQ ID NO: 455652 - DNA, 512 bp, Homo sapiens; identical to SEQ ID NO: 447721
  misc_feature: HEFZJCU01AK7EP.17.33.C11.1.454.heavy.3.raw

SEQ ID NO: 455653 - DNA, 507 bp, Homo sapiens; identical to SEQ ID NO: 449216
  misc_feature: HEFZJCU01ETTNK.47.48.E04.1.454.heavy.3.raw

SEQ ID NO: 455654 - DNA, 523 bp, Homo sapiens
  misc_feature: HEFZJCU01ET7U2.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgtctggggccaggggaccctggtcatcgtctccccagcctccaccaagggcccatccggtcttccccctggtcg

SEQ ID NO: 455655 - DNA, 494 bp, Homo sapiens; identical to SEQ ID NO: 445100
  misc_feature: HEFZJCU01ECOQL.52.53.E09.1.454.heavy.3.raw

SEQ ID NO: 455656 - DNA, 403 bp, Homo sapiens; identical to SEQ ID NO: 445029
  misc_feature: HEFZJCU01D0TW6.10.77.G11.1.454.heavy.3.raw

SEQ ID NO: 455657 - DNA, 500 bp, Homo sapiens; identical to SEQ ID NO: 446033
  misc_feature: HEFZJCU01D0KHE.11.27.C05.1.454.heavy.3.raw

SEQ ID NO: 455658 - DNA, 531 bp, Homo sapiens; identical to SEQ ID NO: 446857
  misc_feature: HEFZJCU01B27NW.7.78.H01.1.454.heavy.3.raw

SEQ ID NO: 455659 - DNA, 510 bp, Homo sapiens
  misc_feature: HEFZJCU01CHQNQ.7.28.C06.1.454.heavy.3.raw
  modified_base (456)..(456): a, c, t, g, unknown or other
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccaggggaggcggctggagtgggtggccaacataaatgacgatgcaaaggagacctactatttggactctgtgaggggccgattcatcatctccagagacaacgccgacactcactgtctctgctgatgagcagcctgagagccgacgacacggctatctattactgtncgaaactctcattccgtcatctgaatactggggccagggaaccctggtcgtccg

SEQ ID NO: 455660 - DNA, 504 bp, Homo sapiens
  misc_feature: HEFZJCU01DTXYF.14.21.B10.1.454.heavy.3.raw
cgtctagtaccacgaccggtgctcgatttagtgtcgtcgcaggagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaagggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagattttggagtggttattatacctttgacttcg

SEQ ID NO: 455661 - DNA, 520 bp, Homo sapiens; identical to SEQ ID NO: 446725
  misc_feature: HEFZJCU01AQY5W.12.86.H09.1.454.heavy.3.raw

SEQ ID NO: 455662 - DNA, 508 bp, Homo sapiens; identical to SEQ ID NO: 445594
  misc_feature: HEFZJCU01CN899.17.25.C03.1.454.heavy.3.raw

SEQ ID NO: 455663 - DNA, 518 bp, Homo sapiens; identical to SEQ ID NO: 444718
  misc_feature: HEFZJCU01B9XEZ.9.34.D01.1.454.heavy.3.raw

SEQ ID NO: 455664 - DNA, 524 bp, Homo sapiens
  misc_feature: HEFZJCU01CEZGO.53.76.G10.1.454.heavy.3.raw
cgcgtatacacacgaccggtgctcgatttagtcactcatacaggggttgggggcaacttataaacccaaaaggaatggccatgcagcgggtagggacaatacagacagatctcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcaggcctggacatcccgggtttccccaggcctggcggtaggtttggggtgaggtctgtgtcactgtggtatgacgatttttggcgtggtttttccttcactattactcccactactacggtttggacgtctgggccaagggaccacggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 455665 - DNA, 523 bp, Homo sapiens; identical to SEQ ID NO: 451418
  misc_feature: HEFZJCU01ER4HJ.12.40.D07.1.454.heavy.3.raw

SEQ ID NO: 455666 - DNA, 510 bp, Homo sapiens; identical to SEQ ID NO: 447226
  misc_feature: HEFZJCU01ARRPS.12.78.H01.1.454.heavy.3.raw

SEQ ID NO: 455667 - DNA, 516 bp, Homo sapiens
  misc_feature: HEFZJCU01AQVNW.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctcgcagcctccaccaagggcccatcc

SEQ ID NO: 455668 - DNA, 503 bp, Homo sapiens
  misc_feature: HEFZJCU01EKRBL.53.76.G10.1.454.heavy.3.raw
cgcgtatacacacgaccggtgctcgatttagtcactcatacagggggagtctccctcactgcccagctgggatctcagggcttcattttctgtcctccaccatcatggggtcaaccgccatcctcgccctcctcctggctgttctccaaggagtctgtgccgaggtgcagctggtgcagtctggaacagaggtgaaaagccgggggagtctctgaagatctcctgtaagggttctggatacaactttaccacctactggatcgcctgggtgcgccagatgcccggaaaaggcctggagtggatgggcatcgtcaatcctagtgactctgaagccacatacagcccgtccttccaaggccaggtcaccctctcagccgacaagtccatcagcgccgccttcctgcagtggcgcggcctggaggcctcggacaccgccacatattactgtgcgagacttacatttggggggagttatcgttgttcctccactgggtgcttttgat

SEQ ID NO: 455669 - DNA, 527 bp, Homo sapiens
  misc_feature: HEFZJCU01EB8GS.9.30.C08.1.454.heavy.3.raw
tgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatacttttaaactttgacttctggggccagggatcccgtggtccaccgtctcctcagcct

SEQ ID NO: 455670 - DNA, 512 bp, Homo sapiens; identical to SEQ ID NO: 445279
  misc_feature: HEFZJCU01EY4G8.17.33.C11.1.454.heavy.3.raw

SEQ ID NO: 455671 - DNA, 505 bp, Homo sapiens
  misc_feature: HEFZJCU01DKZQ9.21.35.D02.1.454.heavy.3.raw
tcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctgaaagaagaggacacggctgtatataactgtgcgcgaggaccttattattatggttcagggaccattgactactggggccagggaaccctggtcaccgtctcctcagcctccaccg

SEQ ID NO: 455672 - DNA, 536 bp, Homo sapiens
  misc_feature: HEFZJCU01DZFBU.12.40.D07.1.454.heavy.3.raw
  modified_base (467)..(467): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagccctgggcggtcccgtgacgactacggcctcgtagttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatctatgggggcttgttctggggccnggggaccctggtcatcgtcctccccacgcctccaccacgggcccatcggtcttccccctggccgcctcg

SEQ ID NO: 455673 - DNA, 396 bp, Homo sapiens; identical to SEQ ID NO: 444469
  misc_feature: HEFZJCU01BDUUS.47.46.E02.1.454.heavy.3.raw

SEQ ID NO: 455674 - DNA, 510 bp, Homo sapiens
  misc_feature: HEFZJCU01BRY2X.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggccaccctcctccaagagcacctctgggggcacagcggccctgggctgcctggtcaaggactacttcctacgtcgtat

SEQ ID NO: 455675 - DNA, 543 bp, Homo sapiens
  misc_feature: HEFZJCU01D9WVM.4.1.A01.1.454.heavy.3.raw
agcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcattaactatgctatccattgggtgcgccaggcccccggacaaaacctgacgtggatgggttggatcaatggtgaaactggaaaaaccaatattcaccgagcttccagggcagaatgaccatctcccgggacacatccgcgagcgcaatctatctggaactgagccgcctgacatctgcagactcggcagtatatttctgtgcgagaggagggggaggatggttggaaggggtaatttggttaattccaattaccttacttttggaaccctacgttcggggggcccaagggggtaaacccccg

SEQ ID NO: 455676 - DNA, 537 bp, Homo sapiens
  misc_feature: HEFZJCU01D81A7.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaacgggcccatcggtccttccccctggccgccctcgcctccacggagccaccctcccggagacgccaccacggccggccccgtgggccgtcgg

SEQ ID NO: 455677 - DNA, 374 bp, Homo sapiens; identical to SEQ ID NO: 444640
  misc_feature: HEFZJCU01AJB05.7.37.D04.1.454.heavy.3.raw

SEQ ID NO: 455678 - DNA, 506 bp, Homo sapiens; identical to SEQ ID NO: 446520
  misc_feature: HEFZJCU01DJX48.10.38.D05.1.454.heavy.3.raw

SEQ ID NO: 455679 - DNA, 491 bp, Homo sapiens; identical to SEQ ID NO: 445899
  misc_feature: HEFZJCU01CCQKD.11.26.C04.1.454.heavy.3.raw

SEQ ID NO: 455680 - DNA, 512 bp, Homo sapiens; identical to SEQ ID NO: 451977
  misc_feature: HEFZJCU01A9SCS.48.34.D01.1.454.heavy.3.raw

SEQ ID NO: 455681 - DNA, 509 bp, Homo sapiens
  misc_feature: HEFZJCU01DREMN.13.71.G05.1.454.heavy.3.raw
tcacgtactacacgaccggtgctcgatttagtgtcgtcgcaagagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaagggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactactactttttgacttac

SEQ ID NO: 455682 - DNA, 374 bp, Homo sapiens
  misc_feature: HEFZJCU01AE8N5.48.59.F04.1.454.heavy.3.raw
agtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggcctgggctgcctggtcaaggactacttcctatgtatact

SEQ ID NO: 455683 - DNA, 485 bp, Homo sapiens
  misc_feature: HEFZJCU01ENXVN.8.33.C11.1.454.heavy.3.raw
ctcgcgtgtccacgaccggtgctcgatttagagtgagctcgttgggtttgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggagaggggaaccagcgggagttccaagtactcctttgacgtctggggccagggtaccctggtcaccgtctcctcagcctccaccaagggcccatcggtcttcccctggcgccctgctccaggagcacctccgagagcacagcggccctgggctgcctggtcaaggactacttccgacacgcgag

SEQ ID NO: 455684 - DNA, 504 bp, Homo sapiens; identical to SEQ ID NO: 452932
  misc_feature: HEFZJCU01B4Z0F.9.33.C11.1.454.heavy.3.raw

SEQ ID NO: 455685 - DNA, 509 bp, Homo sapiens
  misc_feature: HEFZJCU01DL6AS.21.4.A04.1.454.heavy.3.raw
tcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactgggtccgccaggctccagggaaggggctggagtgggtcggccgtattacaaggaaagctaacagttacagtacagaatacggcgcgtctgtgaaaggaaggttcaccatctcaagagatgattcaaagaactcactgtatctgcaaatgaacagcctgaaaaccgaggacacggccgtgtattattgtggtagacaaaagagtaggatgtggtggtagct

SEQ ID NO: 455686 - DNA, 515 bp, Homo sapiens
  misc_feature: HEFZJCU01AM1T8.4.39.D06.1.454.heavy.3.raw
agcactgtagcacgaccggtgctcgatttagtgacatctcgcagttctttgggtttgggggggaagtgtggtacggcctggggggtccctgagactctcctgtacagcctctggattctcctttgatgattatggcatgagctgggtccgccaagctccagggaaggggctggagtgggtgtctggtatgaattggagtggcggtagtacagcttatgcagactctgtgaagggccgattcaccatctccagagacaacgccaagaactccctgtatctgcaattgaacagtctgagagccgaggacacggccttgtattactgtgcgagaacatttagggtgtgtagtggtaacagctgctattcgtcgactgggtttgactactggggccagggagccctggtcaccgtctcctcagcctccaccaagggcccatcggtcttcccctggcgccctgctccaggagcacctccgagagcacagccggccctgggctgcctggtcaaggactacc

SEQ ID NO: 455687 - DNA, 430 bp, Homo sapiens; identical to SEQ ID NO: 444506
  misc_feature: HEFZJCU01BRJA7.52.87.H10.1.454.heavy.3.raw

SEQ ID NO: 455688 - DNA, 512 bp, Homo sapiens
  misc_feature: HEFZJCU01BRKRM.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagccaagacagattttggagtggttactgttggactactttgactactggggccagggaaccctggtcc

SEQ ID NO: 455689 - DNA, 486 bp, Homo sapiens; identical to SEQ ID NO: 444861
  misc_feature: HEFZJCU01AJELK.47.55.E11.1.454.heavy.3.raw

SEQ ID NO: 455690 - DNA, 518 bp, Homo sapiens
  misc_feature: HEFZJCU01AGPN7.47.78.H01.1.454.heavy.3.raw
agctcacgtacacgaccggtgctcgatttagtgtgagtagtttgggtttggggctctgggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttcctttcagtcaagtctggataagctgggtccgccaggctccagggatgggcctggagtgggttggccgtgtcaagagcagaactgatggtgcgacatctgaatacgctgcacccgtgaaaggcagattcaccatctccagagatgattcaataaatatgtcatatctacaaatggatagcctagaaaatcgaggatacaggtgtttattactgttccacagggaatgcggttctctggggccgagggac

SEQ ID NO: 455691 - DNA, 499 bp, Homo sapiens
  misc_feature: HEFZJCU01D4UQV.53.14.B03.1.454.heavy.3.raw
cgcgtatacacacgaccggtgctcgatttagtgtgagtagttccgcgggcctggcgcacccaatggatagcatgggtactgagggtgtatccagaagcctggcaggaaaccttcactgaggccccaggcttcttcgcctcagccccagactgcacaagctggacctgggagtgggcacctgtggctgctgccaccaaaaagaggatcctccaggtccagtccatggtgaggcgttgtgctctgggggcttctgaggagggatgtggttgttgggtcagcgctggcaatggtgacagacactattcacagaagttccagggcagagtcaccatcaccagggacacatccgcgagcacagcctacatggaactgagcagcctgagatctgaagacacgggtgtatattactgtgcgagagggaagtgggatattgtagatgcgccaggtgcccggccggcccctactttgactactggggccggggaaccctggtcaccgt

SEQ ID NO: 455692 - DNA, 524 bp, Homo sapiens
  misc_feature: HEFZJCU01CY8CO.3.82.H05.1.454.heavy.3.raw
  modified_base (292)..(292): a, c, t, g, unknown or other
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccnccaggctccagggaaggggctggagtgggtctcagttatttacaattctggtaccacatactactccgaccccgtgaacgggccgattaaccatctccagagacgattccgagaacacggtgtatcttcaaatgaacaacctgagagccgacgacacggccgtttattactgtgcgagagattcgagtggttcggggacctcaccctggtctacttcgatctctggggccgt

SEQ ID NO: 455693 - DNA, 491 bp, Homo sapiens
  misc_feature: HEFZJCU01CZK1L.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaagggggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 455694 - DNA, 510 bp, Homo sapiens
  misc_feature: HEFZJCU01CMTY7.13.37.D04.1.454.heavy.3.raw
  modified_base (428)..(428): a, c, t, g, unknown or other
tcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggcttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatanctgcagatgaacagcctgggagccgaggacacggtccgtttatcactgtgcgaaagatatttgtaatcgaatgggtagcctg

SEQ ID NO: 455695 - DNA, 496 bp, Homo sapiens
  misc_feature: HEFZJCU01A14WS.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtcctttgaccagtgggccagggaaccctggtcaccgtctcctcagcttccaccaagggcccatcggtcttcccctcggcgccctgctccaggagcacctc

SEQ ID NO: 455696 - DNA, 515 bp, Homo sapiens
  misc_feature: HEFZJCU01C3JPY.19.2.A02.1.454.heavy.3.raw
tactctcgtgcacgaccggtgctcgatttagactcatctacagggggctttctgagagtcatggacctcctgcacaagaacatgaaacacctgtggttcttcctcctcctggtggcagctcccagatgggtcctgtcccaggtgcagctacagcagtggggcgcaggactgttaaagccttcggagaccctgtccctcacctgcgctgtctatggtgggtccttcagaggttactactggagttggatccgccagcccccagggaagggactggagtggattggggaaatcaatcatagtggaagcgccagctacaacccgtccctcaagagtcggctcgacatattagtagacacgcccaagagtcagttctccctgaagctgggctctgtgaccgccgccgacacggctgtctatttctgtgcgagagttggatattgtgctggtggtagctgctacgccgcgtttcagttagactactggggtcagggaaccctggtcaccgtctcctcacg

SEQ ID NO: 455697 - DNA, 526 bp, Homo sapiens
  misc_feature: HEFZJCU01CS0FM.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctcccttgacttctggggccatggaacccggt

SEQ ID NO: 455698 - DNA, 524 bp, Homo sapiens
  misc_feature: HEFZJCU01B7USO.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccactcggtcttccccctggccg

SEQ ID NO: 455699 - DNA, 464 bp, Homo sapiens; identical to SEQ ID NO: 445533
  misc_feature: HEFZJCU01BM97C.19.10.A10.1.454.heavy.3.raw

SEQ ID NO: 455700 - DNA, 529 bp, Homo sapiens
  misc_feature: HEFZJCU01BHHSZ.14.35.D02.1.454.heavy.3.raw
cgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactggggccagggaaccctggtcaccgtctcctcagcctccaccaagggcccatcggtcttccccctggcaccctcctccaagagcacctctgggggcacagcggccctgggctgcctggtcaaggactacttccg

SEQ ID NO: 455701 - DNA, 506 bp, Homo sapiens
  misc_feature: HEFZJCU01AYAXV.51.5.A05.1.454.heavy.3.raw
cgatcgtatacacgaccggtgctcgatttagatagatagacagggggctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtcctgcacctcgtgtggcccatttggtttaccggcacacaaaatcagggcaagtcctacgacggtctgg

SEQ ID NO: 455702 - DNA, 504 bp, Homo sapiens; identical to SEQ ID NO: 455660
  misc_feature: HEFZJCU01CMLXK.14.21.B10.1.454.heavy.3.raw

SEQ ID NO: 455703 - DNA, 491 bp, Homo sapiens
  misc_feature: HEFZJCU01EIEAA.53.68.G02.1.454.heavy.3.raw
cgcgtatacacacgaccggtgctcgatttagtcgatagtgaagggaaagggtgtacacctgagactctcctgtgcagcctctggattcacgtttgatgattctgtcatgcactgggtccggcaaactccagggaagggcctggagtggctctcaggcattacttggaatagtggcagtacaggttatgcggactctgtgaagggccgattcaccatctccagagacaacagcaaggagctcctttatttacaaatggacagcctgagagttgaggacacggccgtatattactgtgtgaaagacagcggcccacctcgcagttggtattactattacgggatggacatctggggccgagggaccacggtcaccgtctcctcagcctccaccaagggcccatcggtcttcccctggcgccctgctccaggagcacctccgagagcacagcggccctgggctgcctggtcaaggactacttcctcgtactgcg

SEQ ID NO: 455704 - DNA, 483 bp, Homo sapiens
  misc_feature: HEFZJCU01DTQSR.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 455705 - DNA, 528 bp, Homo sapiens
  misc_feature: HEFZJCU01ATY9W.22.11.A11.1.454.heavy.3.raw
acatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccgcgggggtcacccaaattgactactggggccagggaaccctggtcaccgtctcctcagcctccaccaaggcccatcggtccttccccctcggccgccctcgctccac

SEQ ID NO: 455706 - DNA, 490 bp, Homo sapiens; identical to SEQ ID NO: 449684
  misc_feature: HEFZJCU01DOM03.4.57.F02.1.454.heavy.3.raw

SEQ ID NO: 455707 - DNA, 497 bp, Homo sapiens
  misc_feature: HEFZJCU01AZOAS.48.23.C01.1.454.heavy.3.raw
agtatacatacacgaccggtgctcgatttagtacacgtgattagggattggggacccaacaaccacatccctcctcagaagcccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcacaacctacactatgcattgggtgcgccaggcccccggacaaagccttgagtggatggggtggctcaacgctggcgatggtcagacaaagtattcacagaagttccagggcagagtcaccatcaccagggacacgtccgcgagtagtgtcttcatggagctgcgcagtctgagatcggaagacacggcagtatattactgtgcgagaggcggatattgtcgtcgaggtgactgctacagtcaaatcgtg

SEQ ID NO: 455708 - DNA, 500 bp, Homo sapiens
  misc_feature: HEFZJCU01BE1OS.52.83.H06.1.454.heavy.3.raw
cgcagtacgacacgaccggtgctcgatttagatcacgtgcgtcgcggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctgatgcctccatcagtcgtgacgattactactggagctggatccgccagcccccagggaagggcctggaatggattggctacatcttttacagtgagagcacctcctacaacccgtccctcaagagtcgagttaccatatcagctgacaagtccaagaaccacttctccctgaagctgacctctgtgactgccacagacacggccgtctattactgtgccagagggatcgctagaggtggctccatcgttttagactcctggggccagggaaccctggtctccgt

SEQ ID NO: 455709 - DNA, 375 bp, Homo sapiens; identical to SEQ ID NO: 445125
  misc_feature: HEFZJCU01DGB7H.9.53.E09.1.454.heavy.3.raw

SEQ ID NO: 455710 - DNA, 490 bp, Homo sapiens; identical to SEQ ID NO: 446494
  misc_feature: HEFZJCU01BF45Z.11.13.B02.1.454.heavy.3.raw

SEQ ID NO: 455711 - DNA, 527 bp, Homo sapiens
  misc_feature: HEFZJCU01EUTNL.52.55.E11.1.454.heavy.3.raw
cgcagtacgacacgaccggtgctcgatttagcactcgcacgttgggtttggggaacaaccagattcctcctctaaagaagcccctgggagcacagctcatcaccatggactggacctggaggttcctctttgtggtggctgcagttacagctgtccagtcccaggtccacctggtgcagtctggggctgaagtaaagaagcctgggtcgtcggtgaaggtctcctgcagggcctctggagccaccttcggcacttatgggatcagctgggtgcgccaggcccctggacaagggcttgagtggatgggaagggtcatccctttctttgatttaacgaactacgcacagaaattccagggcagagtcaccattaccgcggacgaatccacgaccacagcctacatggagctgcgcaacctaagatctgacgacacggccgtgttttactgtgcgagatttacagtctcgcccacaacttctggtggcggcggtgttccaccttactactttgactcctggggccaggga

SEQ ID NO: 455712 - DNA, 516 bp, Homo sapiens
  misc_feature: HEFZJCU01C4Q72.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctcgggctcg

SEQ ID NO: 455713 - DNA, 533 bp, Homo sapiens
  misc_feature: HEFZJCU01CXHYW.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgaccctggggcccgggaaccctggtcaccgtctcctcagcctccaccaagggcccatcggtcttcccctc

SEQ ID NO: 455714 - DNA, 506 bp, Homo sapiens
  misc_feature: HEFZJCU01DR08X.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggccgccctgctccaggagcacctctgggggcac

SEQ ID NO: 455715 - DNA, 489 bp, Homo sapiens; identical to SEQ ID NO: 444791
  misc_feature: HEFZJCU01CF3DH.47.85.H08.1.454.heavy.3.raw

SEQ ID NO: 455716 - DNA, 546 bp, Homo sapiens
  misc_feature: HEFZJCU01D1HIS.11.25.C03.1.454.heavy.3.raw
cgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattaccgtgtgagagagtagggccggaccgaacgtaacgttacgaccgtatagtcggtacgtgggtcggacggaaccggaaccgtccg

SEQ ID NO: 455717 - DNA, 525 bp, Homo sapiens
  misc_feature: HEFZJCU01CI69O.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggccggggaaccctggtcaccgtctcccaccctccaccaagggcccatcggtcttccccctggcaccctcctccaagagcacctctgggggcacagcggccctgggctgcctggtcaaggactacttcccatactcgta

SEQ ID NO: 455718 - DNA, 395 bp, Homo sapiens; identical to SEQ ID NO: 444517
  misc_feature: HEFZJCU01ECYG8.16.68.G02.1.454.heavy.3.raw

SEQ ID NO: 455719 - DNA, 470 bp, Homo sapiens
  misc_feature: HEFZJCU01CDIU0.48.49.E05.1.454.heavy.3.raw
agtatacatacacgaccggtgctcgatttagagcgactagcaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtggtggcacacgctattcacagaagtttcagggcagggtcaccatgaccagggacacgtccatcagcacagcctacatggaattgagcaggctgacatctgacgacacggccgtggtattattgtgcgagag

SEQ ID NO: 455720 - DNA, 483 bp, Homo sapiens; identical to SEQ ID NO: 453752
  misc_feature: HEFZJCU01CNBJR.19.53.E09.1.454.heavy.3.raw

SEQ ID NO: 455721 - DNA, 510 bp, Homo sapiens
  misc_feature: HEFZJCU01B1KR0.10.38.D05.1.454.heavy.3.raw
catagtagtgcacgaccggtgctcgatttagtatctgatagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacacgcggccctggggcctggtccg

SEQ ID NO: 455722 - DNA, 502 bp, Homo sapiens
  misc_feature: HEFZJCU01A4T8T.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatcgtggggccaaggggac

SEQ ID NO: 455723 - DNA, 506 bp, Homo sapiens
  misc_feature: HEFZJCU01ANS2K.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggcttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggg

SEQ ID NO: 455724 - DNA, 437 bp, Homo sapiens; identical to SEQ ID NO: 444603
  misc_feature: HEFZJCU01CJ6TY.3.21.B10.1.454.heavy.3.raw

SEQ ID NO: 455725 - DNA, 519 bp, Homo sapiens
  misc_feature: HEFZJCU01ATS0Z.12.58.F03.1.454.heavy.3.raw
atacgacgtacacgaccggtgctcgatttagtctgatcgagaagggaaaggggcagagaggagccttagccctggactccaaggcctttccacttggtgatcagcactgagcacagaggactcaccatggaattggggctgagctgggttttccttgttgctattttagaaggtgtccagtgtgagggacaattggtggagtctgggggaggcttggtccagccgggggggtccctgagactctcctgtacagcctctggattcactctcggaaacttttggatggtctgggtccgccaggctccagggaaggggctggagtgggtggccaatatacagtcaggtggaggtacgatacactatctcgactctgtgaagggccggttcaccatctccagagacaacgccaagaattcactgtatctgcaaatgaacagcctgagagtcgaagacacgggtatttattattgtgtgcgagatctggatttccttcgaatgaagtgtggttcgatgtgtttg

SEQ ID NO: 455726 - DNA, 427 bp, Homo sapiens; identical to SEQ ID NO: 444708
  misc_feature: HEFZJCU01EKE9R.9.34.D01.1.454.heavy.3.raw

SEQ ID NO: 455727 - DNA, 533 bp, Homo sapiens
  misc_feature: HEFZJCU01A5UCS.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacgacgggcgtttattactgtgcgagaggggacggactacggtgactacgtgggggttcggaccccgtggggccagggaaccctggtcaccgtctcctcagcctccaacccg

SEQ ID NO: 455728 - DNA, 505 bp, Homo sapiens
  misc_feature: HEFZJCU01DY2J4.48.18.B07.1.454.heavy.3.raw
agtatacatacacgaccggtgctcgatttagtcgctgcgtaagggggagagaggagccttagccctggattccaaggcctatccacttggtgaccagcactgagcaccgagggttcaccatggaattggggctccgctgggttttcctggttgctgttttagcaggtggccagtgtgacgtgcacctgctggagtcggggggaggcctggtcaagcggggggggtccctgagactctcttgtgaagcctctaaaatcagtctcgagagttccagcatgaactgggtccgccaggctccagggaagggcctggagtgggtctcatccatcagcagtggaggcaaccatatgttgtatgccgactcagtgaggggccgattcagcgtctccagagacaacgccaagatgtcagtatatctggaaatgaacaacctaagagtcgaggacacggctgtctactactgtgcgagagatgtgattccagtgactggtgggtggtactttga

SEQ ID NO: 455729 - DNA, 521 bp, Homo sapiens
  misc_feature: HEFZJCU01B5HCL.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtattggaaatgaacagcctaagtcctgaggacacgggtgtatactactgtacgaagggaggggggaaccgaggcgggagttccgaagtacttccg

SEQ ID NO: 455730 - DNA, 532 bp, Homo sapiens; identical to SEQ ID NO: 445228
  misc_feature: HEFZJCU01BE1E8.7.78.H01.1.454.heavy.3.raw

SEQ ID NO: 455731 - DNA, 471 bp, Homo sapiens
  misc_feature: HEFZJCU01BK214.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggacgcacctccgagagcacagcggccctgggctgcctggtcaaggactacttccctacagtgct

SEQ ID NO: 455732 - DNA, 507 bp, Homo sapiens; identical to SEQ ID NO: 454089
  misc_feature: HEFZJCU01CS0CV.14.78.H01.1.454.heavy.3.raw

SEQ ID NO: 455733 - DNA, 477 bp, Homo sapiens; identical to SEQ ID NO: 444659
  misc_feature: HEFZJCU01D6ERH.16.10.A10.1.454.heavy.3.raw

SEQ ID NO: 455734 - DNA, 480 bp, Homo sapiens
  misc_feature: HEFZJCU01C4A2B.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataacagtctgagacttgaggacacggctgtctattactgtgcgagagactacggtgaccttttctggtatttcgatctctgggccgtggcaccctggtcactgtctcctcggcttccaccaagggccatcggtcttcccctgcgcctgctca

SEQ ID NO: 455735 - DNA, 510 bp, Homo sapiens; identical to SEQ ID NO: 452275
  misc_feature: HEFZJCU01CNJQE.10.5.A05.1.454.heavy.3.raw

SEQ ID NO: 455736 - DNA, 501 bp, Homo sapiens
  misc_feature: HEFZJCU01BT8JN.10.71.G05.1.454.heavy.3.raw
catagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacggggtgtttattactgtgggagaaatcctagtggcatcacctggtt

SEQ ID NO: 455737 - DNA, 500 bp, Homo sapiens
  misc_feature: HEFZJCU01DOXIW.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgtgctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggcc

SEQ ID NO: 455738 - DNA, 525 bp, Homo sapiens
  misc_feature: HEFZJCU01DJB3U.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaaggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgacccctggggccagggaaccctggtcaccgtctcctcagcctccaccg

SEQ ID NO: 455739 - DNA, 532 bp, Homo sapiens
  misc_feature: HEFZJCU01DYEBE.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccagggagccctggtcaccgt

SEQ ID NO: 455740 - DNA, 520 bp, Homo sapiens
  misc_feature: HEFZJCU01DBX8G.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtgggccagggaaccctggtcaccgtctcctcagcttccaccaagggcccatcggtccttcccctggccgccctgcctccaggagcacctccgtgggggcacacgcggcccgg

SEQ ID NO: 455741 - DNA, 515 bp, Homo sapiens; identical to SEQ ID NO: 448327
  misc_feature: HEFZJCU01EZX9M.13.21.B10.1.454.heavy.3.raw

SEQ ID NO: 455742 - DNA, 497 bp, Homo sapiens
  misc_feature: HEFZJCU01DFDL7.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacgtggtttggggctactggggccagggaaccctggtcaccgtctcctcagcctccaaccg

SEQ ID NO: 455743 - DNA, 513 bp, Homo sapiens
  misc_feature: HEFZJCU01BQ9Q7.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaacgagcacctctgggggcacagcggccctgggctgcctggtcaaggactacttccgagtgcgtct

SEQ ID NO: 455744 - DNA, 500 bp, Homo sapiens; identical to SEQ ID NO: 446033
  misc_feature: HEFZJCU01CF3C6.11.27.C05.1.454.heavy.3.raw

SEQ ID NO: 455745 - DNA, 518 bp, Homo sapiens
  misc_feature: HEFZJCU01C2IUP.26.57.F02.1.454.heavy.3.raw
agactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggttcaccatctccagagatgattcagagaacacggcgtatctgcaaatgaacagcctgaaaaccgaggacacggccgtgtattactgtgccagacatccgtcgtattacgatttttcagtggtccc

SEQ ID NO: 455746 - DNA, 477 bp, Homo sapiens
  misc_feature: HEFZJCU01D0CP4.3.39.D06.1.454.heavy.3.raw
agacgcactccacgaccggtgctcgatttagtgacatctcgcagttctttgggttttggggggtccctgagactctcatgtacaggctctgagttcagcgtcactaaatactacatgagctgggtccgccaggctccagggaggggactggactgggtctccagtgttaacagcgatggaagtacatattatgcagactccgtgaagggccgattcaccatctccagagacaattccaagaacactctgtatcttcaaatgaacagcctgagagccgaggacacggccttctattactgtgcgagcgatcacgggcggagtctgatactttcttggggccagggaaccctggtcaccgtctcctcagcctccaccaagggcccatcggtcttccccctggccgccctgctccaggagcacctccgagagcacagcggccctgggctgcctggtcaaggactacttccgagtgcgtct

SEQ ID NO: 455747 - DNA, 513 bp, Homo sapiens
  misc_feature: HEFZJCU01CEL2O.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaaatttggcgggctactacgagaacggattgggcgcctggggccaagggaccacggtcatcgtctccgcagcctccaccaagggcccatcggtcttcccctggcaccctcctccaagagcacctcgtgggggcacagcggccctgggctgcctggtcaggactacttccgagtgcgtct

SEQ ID NO: 455748 - DNA, 504 bp, Homo sapiens; identical to SEQ ID NO: 445222
  misc_feature: HEFZJCU01A79XH.9.33.C11.1.454.heavy.3.raw

SEQ ID NO: 455749 - DNA, 529 bp, Homo sapiens
  misc_feature: HEFZJCU01D64W4.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgctactgggccagggaaccctggtcaccgtctcctcagcctcaccaaggg

SEQ ID NO: 455750 - DNA, 536 bp, Homo sapiens
  misc_feature: HEFZJCU01BDF6M.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattcccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaagtaatggctgtgtttattggggccagggagccgtggtcaccg

SEQ ID NO: 455751 - DNA, 395 bp, Homo sapiens; identical to SEQ ID NO: 444517
  misc_feature: HEFZJCU01AYVDL.16.68.G02.1.454.heavy.3.raw

SEQ ID NO: 455752 - DNA, 378 bp, Homo sapiens; identical to SEQ ID NO: 444463
  misc_feature: HEFZJCU01DLNMF.47.77.G11.1.454.heavy.3.raw

SEQ ID NO: 455753 - DNA, 508 bp, Homo sapiens; identical to SEQ ID NO: 446002
  misc_feature: HEFZJCU01CFQOB.9.78.H01.1.454.heavy.3.raw

SEQ ID NO: 455754 - DNA, 492 bp, Homo sapiens; identical to SEQ ID NO: 444695
  misc_feature: HEFZJCU01BOX5H.3.34.D01.1.454.heavy.3.raw

SEQ ID NO: 455755 - DNA, 515 bp, Homo sapiens
  misc_feature: HEFZJCU01EBIPQ.48.38.D05.1.454.heavy.3.raw
agtatacatacacgaccggtgctcgatttagtatctgatagttgggtttggggggaagaggaagactgacggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaaggcccatcggtcttccccctggcgccctgctccaggagcacctccgagagcacagcggccctgggctgcctggtcaaggactacttcctatgta

SEQ ID NO: 455756 - DNA, 529 bp, Homo sapiens
  misc_feature: HEFZJCU01DMN6T.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactacgtgggggttcgaccccgtggggccaggggaaccctggtcaccgtctcctcagcctccaccg

SEQ ID NO: 455757 - DNA, 531 bp, Homo sapiens
  misc_feature: HEFZJCU01CR1L9.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggggccggggaaccctggtcaccgtcctccccaccctccaccg

SEQ ID NO: 455758 - DNA, 504 bp, Homo sapiens
  misc_feature: HEFZJCU01CBDKL.48.44.D11.1.454.heavy.3.raw
agtatacatacacgaccggtgctcgatttagcgcagtacgaggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaggactacttcctatgtatact

SEQ ID NO: 455759 - DNA, 370 bp, Homo sapiens; identical to SEQ ID NO: 446460
  misc_feature: HEFZJCU01EORUB.14.77.G11.1.454.heavy.3.raw

SEQ ID NO: 455760 - DNA, 522 bp, Homo sapiens
  misc_feature: HEFZJCU01CN69E.48.68.G02.1.454.heavy.3.raw
agtatacatacacgaccggtgctcgatttagtcgatagtgaagggaaaggggctgggagaggagccccagccctgagattcccaggtgtttccattcagtgatcagcactgaacacagaggactcaccatggagttgggactgaactggattttccttttggctattttaaaaggtgtccagtgtgaactgcaactggtggagtctgggggaggcttggtacagcctggcaggtccctgagactctcctgtgcagcctctggattcacctttggtgattatgccatgcactgggtccggcaagctccagggaagggcctggagtgggtctcaggtattagttggaatagtgatagcataggctatgcggactctgtgaagggccgattcaccatctccagagacaacgccaagaactccctgtatctgcaaatgaacagtctgagaactgaggacacggccttgtattactgtgtaaaagatatgtagtttttggggttcggggtaggtttggaggcggtcg

SEQ ID NO: 455761 - DNA, 525 bp, Homo sapiens
  misc_feature: HEFZJCU01BJFCX.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgaactgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctgggagtgggtctcagttatttacaattctggtaccacatactactccgacccgtgaagggccgattaaccatctccagagacgattccgagaacacggtgtatcttcaaatgaacaacctgagagccgacgacacggccgtttattactgtgcgagagattcgagtggtcggggacctcaccctggttctacttcgatctctggggccgtgg

SEQ ID NO: 455762 - DNA, 513 bp, Homo sapiens
  misc_feature: HEFZJCU01BKHLJ.4.25.C03.1.454.heavy.3.raw
agcactgtagcacgaccggtgctcgatttagtagtgtagatttgggtttgggctgagcgtgggttttcctcgttagctcttttaagaggtgtccagtgtcacgtgcgcctggtggagtctggggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtcgtggggccgtagggactacggtcaccgtctcctcagcctccaccaaggcccatcggtccttcccc

SEQ ID NO: 455763 - DNA, 510 bp, Homo sapiens
  misc_feature: HEFZJCU01CR36E.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttccccctggccaccctcctccaagagcacctctgggggcacagcggccctgggctgcctggtcaaggactacttctacgtcgtat

SEQ ID NO: 455764 - DNA, 503 bp, Homo sapiens
  misc_feature: HEFZJCU01BABJI.3.67.G01.1.454.heavy.3.raw
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaatgaacagcctggaagacgcggacacagccatgtatttattgtacatttaggacactatacg

SEQ ID NO: 455765 - DNA, 396 bp, Homo sapiens; identical to SEQ ID NO: 444469
  misc_feature: HEFZJCU01A7SJ6.47.46.E02.1.454.heavy.3.raw

SEQ ID NO: 455766 - DNA, 495 bp, Homo sapiens
  misc_feature: HEFZJCU01ATMEN.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagacttcgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagctccaccaagggcccatcggtcttcccctggcaccctcctccaagagcacctctgggggcacagcggccctgggctgcctggtcaaggactacttccgagtagtaca

SEQ ID NO: 455767 - DNA, 492 bp, Homo sapiens; identical to SEQ ID NO: 444695
  misc_feature: HEFZJCU01AD9VG.3.34.D01.1.454.heavy.3.raw

SEQ ID NO: 455768 - DNA, 313 bp, Homo sapiens; identical to SEQ ID NO: 445488
  misc_feature: HEFZJCU01CU18V.49.8.A08.1.454.heavy.3.raw

SEQ ID NO: 455769 - DNA, 507 bp, Homo sapiens
  misc_feature: HEFZJCU01DXF5K.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgcctgctccaggagcacctccgagagcacagcggccctgggatgcctggtcaaggactacttccagacgtatca

SEQ ID NO: 455770 - DNA, 486 bp, Homo sapiens
  misc_feature: HEFZJCU01A53ZZ.15.8.A08.1.454.heavy.3.raw
tctacgtagccacgaccggtgctcgatttagcatactctacaggggtccctgagactctcctgtgccgcctctggagcagagtctgaattcaccttcatgcactttgccatgagctgggtccgccaggctccggggaagggctggagtgcgtcgcatgtataactaaaagtggagacatcacactctacgcagactccgtgaagggccgcttcaccatctccagagacaactccaagaacacgctgtccctggagatgaacagcctgagagccgaggacacggccatttattactgtgcgaaagatagttcggggagtaattatcgagaatactattttgactcctgggccagggagccctggtcaccgtctcctcagcctccaccaagggcccatcggtcttcccctggcaccctcctccaagagcacctctgggggcacagcggccctgggctgcctggtcaaggactacttccgctacgtaga

SEQ ID NO: 455771 - DNA, 519 bp, Homo sapiens
  misc_feature: HEFZJCU01EK3G2.10.85.H08.1.454.heavy.3.raw
catagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctcgtgggggccaggggaaccctggt

SEQ ID NO: 455772 - DNA, 383 bp, Homo sapiens; identical to SEQ ID NO: 445880
  misc_feature: HEFZJCU01EIJWG.22.46.E02.1.454.heavy.3.raw

SEQ ID NO: 455773 - DNA, 517 bp, Homo sapiens; identical to SEQ ID NO: 452444
  misc_feature: HEFZJCU01DHIAJ.9.34.D01.1.454.heavy.3.raw

SEQ ID NO: 455774 - DNA, 521 bp, Homo sapiens; identical to SEQ ID NO: 445317
  misc_feature: HEFZJCU01EFDCC.12.40.D07.1.454.heavy.3.raw

SEQ ID NO: 455775 - DNA, 510 bp, Homo sapiens
  misc_feature: HEFZJCU01CH337.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaggcagattcatcatctcaagagatgattccaacggcatcgcctatctgcagatgaacagcctgaagaccgaggacacagccgtctattactgtgttagggtagttttacgtatttttggt

SEQ ID NO: 455776 - DNA, 482 bp, Homo sapiens; identical to SEQ ID NO: 444503
  misc_feature: HEFZJCU01DA3EO.7.10.A10.1.454.heavy.3.raw

SEQ ID NO: 455777 - DNA, 512 bp, Homo sapiens; identical to SEQ ID NO: 453122
  misc_feature: HEFZJCU01DTL4H.11.13.B02.1.454.heavy.3.raw

SEQ ID NO: 455778 - DNA, 520 bp, Homo sapiens
  misc_feature: HEFZJCU01ALQ91.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgagggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggaccg

SEQ ID NO: 455779 - DNA, 507 bp, Homo sapiens
  misc_feature: HEFZJCU01CUFT6.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 455780 - DNA, 516 bp, Homo sapiens
  misc_feature: HEFZJCU01DWF5M.26.71.G05.1.454.heavy.3.raw
agactatactcacgaccggtgctcgatttagtgtcgtcgcaagagagaggggggggggaagaggaagactgacggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagaatatgactattggggccagggaattttggtcaccgtctccccagcctccaccaagggcccatcggtcttcccctggcgccctgctccaggagcacctccgagagcacagcggccctgggctgcctggtcaaggactactcc

SEQ ID NO: 455781 - DNA, 503 bp, Homo sapiens
  misc_feature: HEFZJCU01BWPRL.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacgggccatatatttctgtgcgcgaggaatttcgacttctggaataattacttggttggaactacctt

SEQ ID NO: 455782 - DNA, 512 bp, Homo sapiens
  misc_feature: HEFZJCU01DV2C5.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcggagggggccgggatattgttatagaaccacctgctatctgagctggttcgactgctggggccagggaaccctggtcaccg

SEQ ID NO: 455783 - DNA, 490 bp, Homo sapiens; identical to SEQ ID NO: 449137
  misc_feature: HEFZJCU01DVWQ6.11.26.C04.1.454.heavy.3.raw

SEQ ID NO: 455784 - DNA, 400 bp, Homo sapiens; identical to SEQ ID NO: 444452
  misc_feature: HEFZJCU01B9ZFJ.47.24.C02.1.454.heavy.3.raw

SEQ ID NO: 455785 - DNA, 496 bp, Homo sapiens
  misc_feature: HEFZJCU01EA24U.40.37.D04.1.454.heavy.3.raw
tctagcgactcacgaccggtgctcgatttagtagcatactgttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccgggaatcctggtcaccgtctcctcagcctccaccaagggcccatcggtcttcccctggcgccctgctccaggagcacctccgagagcacagcggccctgggctgcctggtcaaggactacttccagtcgctaga

SEQ ID NO: 455786 - DNA, 423 bp, Homo sapiens; identical to SEQ ID NO: 444772
  misc_feature: HEFZJCU01BGLXV.16.78.H01.1.454.heavy.3.raw

SEQ ID NO: 455787 - DNA, 529 bp, Homo sapiens
  misc_feature: HEFZJCU01EAMIL.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgacttctggggccatcggaacccggtccg

SEQ ID NO: 455788 - DNA, 489 bp, Homo sapiens; identical to SEQ ID NO: 444791
  misc_feature: HEFZJCU01AXZSZ.47.85.H08.1.454.heavy.3.raw

SEQ ID NO: 455789 - DNA, 517 bp, Homo sapiens
  misc_feature: HEFZJCU01CRKKC.10.85.H08.1.454.heavy.3.raw
  modified_base (456)..(456): a, c, t, g, unknown or other
catagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgagggggagccggctanggttcggacctctggggccagggaaccctggtcaccgtctcatcagcctccaccaaggccc

SEQ ID NO: 455790 - DNA, 469 bp, Homo sapiens; identical to SEQ ID NO: 454497
  misc_feature: HEFZJCU01AQ6SN.48.56.F01.1.454.heavy.3.raw

SEQ ID NO: 455791 - DNA, 527 bp, Homo sapiens
  misc_feature: HEFZJCU01DIL81.48.26.C04.1.454.heavy.3.raw
agtatacatacacgaccggtgctcgatttagtctagcgactttgggtttggggggaagaggaagactgacggtccccccaggagttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttactatggttcggggagtctccgacccagcaactggttcgacccgtggggccagggaaccctggtcaccgtctcctcagcctccaccaagggcccatcggtcttcccctggcaccctcctccaagagcacctctgggggcacac

SEQ ID NO: 455792 - DNA, 310 bp, Homo sapiens; identical to SEQ ID NO: 444473
  misc_feature: HEFZJCU01DNSKU.18.53.E09.1.454.heavy.3.raw

SEQ ID NO: 455793 - DNA, 512 bp, Homo sapiens
  misc_feature: HEFZJCU01DQ5C1.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtaatcttcaaataaacagtctgagacttgaggacacggctgtctattactgtgcgagagactacggtgaccttttctggtatttcgatctctggggccgtggcaccctggtcactgtctcctcggcttccaccaagggcccatcggtctcccctggcgccctgctccaggagcacctctggggcacagcggccg

SEQ ID NO: 455794 - DNA, 499 bp, Homo sapiens
  misc_feature: HEFZJCU01CJIFU.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtcgtggggccaagggaccacggtcaccgtctcctcacgcctccacc

SEQ ID NO: 455795 - DNA, 514 bp, Homo sapiens
  misc_feature: HEFZJCU01A0AHJ.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctgggttttccttgttgctatttcaaaaggtgtccagtgtgaggtgcagttggtggagactggaggaagcctgatccagccgggggggtccctgagactgtcctgtgtagtctctgggttcagcgtcagtcgcgaccacatgagttggttccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgtcgagcgacccggggctccgtcaatggctttcattact

SEQ ID NO: 455796 - DNA, 491 bp, Homo sapiens
  misc_feature: HEFZJCU01ECKQM.10.85.H08.1.454.heavy.3.raw
catagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctttatggttcggacctcgtggggccagggaaccctggtcaccgtctcatcagcctccaccaagggcccatcggtcttcccctggcgccctgctccaggagcacctccgagagcacagccggccctgggctgcctggtcaaggactacttcccactactatg

SEQ ID NO: 455797 - DNA, 486 bp, Homo sapiens
  misc_feature: HEFZJCU01CNZ5H.53.25.C03.1.454.heavy.3.raw
cgcgtatacacacgaccggtgctcgatttagtagtgtagatttgggtttgggggggtccctgagactctcctgtgcagcctctggattcaccttcagaaattattggatgcactgggtccgccatgttccggggaaggggctgttgtgggtctcacgtattaatggagatgggagcagcacacacaacgcggactccgtgaagggccgattcatcatctccagagacaacgtcaagaatatactatatctgcagatgaatggtctgagggccgacgactcggctgtgttctactgtgcaagaggcggcagtggctacagtgcctactactacggtctggacgtctggggccaggggaccactgtcaccgtctcctcagcctccaccaagggcccatcggtcttcccctggcaccctcctccaagagcacctctgggggcacagcggccctgggctgcctggtcaaggactacttcctcgtactgcg

SEQ ID NO: 455798 - DNA, 500 bp, Homo sapiens
  misc_feature: HEFZJCU01CJ1FE.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagctttgatctctggggccaagggacactggtcacgtctcttcagcctccaccaaggcccatcgtctcccctggcgcctgctcaggacg

SEQ ID NO: 455799 - DNA, 499 bp, Homo sapiens
  misc_feature: HEFZJCU01D5SZ7.19.86.H09.1.454.heavy.3.raw
tactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacgggctaaaggcataaagtggttcgacccctggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 455800 - DNA, 510 bp, Homo sapiens; identical to SEQ ID NO: 449039
  misc_feature: HEFZJCU01BF6HH.7.28.C06.1.454.heavy.3.raw

SEQ ID NO: 455801 - DNA, 392 bp, Homo sapiens; identical to SEQ ID NO: 444456
  misc_feature: HEFZJCU01DG4M7.7.60.F05.1.454.heavy.3.raw

SEQ ID NO: 455802 - DNA, 484 bp, Homo sapiens; identical to SEQ ID NO: 445311
  misc_feature: HEFZJCU01EQYHY.11.23.C01.1.454.heavy.3.raw

SEQ ID NO: 455803 - DNA, 529 bp, Homo sapiens
  misc_feature: HEFZJCU01D6HMT.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaacgggcccatcggtcttccccctggccgccctgctccaggagcacctccgagacg

SEQ ID NO: 455804 - DNA, 505 bp, Homo sapiens; identical to SEQ ID NO: 445664
  misc_feature: HEFZJCU01DSP6Y.12.33.C11.1.454.heavy.3.raw

SEQ ID NO: 455805 - DNA, 491 bp, Homo sapiens
  misc_feature: HEFZJCU01DALBV.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggaggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagcacctccgagagcacagcggccctgggctgcctggtcaaggactacttccgtatctctcg

SEQ ID NO: 455806 - DNA, 522 bp, Homo sapiens
  misc_feature: HEFZJCU01EL2DN.16.86.H09.1.454.heavy.3.raw
  modified_base (497)..(497): a, c, t, g, unknown or other
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactggggccagggaancttggtcaccgtctcctcagcctcc

SEQ ID NO: 455807 - DNA, 496 bp, Homo sapiens; identical to SEQ ID NO: 444697
  misc_feature: HEFZJCU01C1K5I.16.37.D04.1.454.heavy.3.raw

SEQ ID NO: 455808 - DNA, 492 bp, Homo sapiens; identical to SEQ ID NO: 444695
  misc_feature: HEFZJCU01BAUD4.3.34.D01.1.454.heavy.3.raw

SEQ ID NO: 455809 - DNA, 503 bp, Homo sapiens
  misc_feature: HEFZJCU01DDT0X.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttattgaaacagatggcactacatattattctgactccgtgaagggccggttcaccctctccagagacacttccaacaacatcttgtatcttcacatgcacaatctgagagtcgacgacacggcccacctattattgtgcgcgacatgactacgctcaatttctggggccg

SEQ ID NO: 455810 - DNA, 515 bp, Homo sapiens
  misc_feature: HEFZJCU01BBAQ8.49.87.H10.1.454.heavy.3.raw
agtcgagagacacgaccggtgctcgatttagcagtactgcgttgggtttgggggggagaggagcccagcactagaagtcggcggtgtttccattcggtgatcagcactgaacacagaggactcaccatggagtttgggctgagctgggttttcctcgttgctcttttaagaggtgtccattgtcaggtgcagttaatggagtcggggggatctgtggtccggcctgggaggtccctgagactctcctgtgcagcctccggattcaacttcgggaactatggcttacactgggtccgccaggctccaggcaaggggctggagtgggtggcagttatttcatatgattcaagtattggatattacgcagagtccgtaaagggccgattcaccatctccagagacaattcgaagaacaccatgtatctggaactgagcagagtcacatctgaggacacggctatgtattactgttgtgaaagacttttatgacagtagtggttttctccgagtatgca

SEQ ID NO: 455811 - DNA, 498 bp, Homo sapiens
  misc_feature: HEFZJCU01CVPGY.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggccctggctgcctggtcaaggactactccga

SEQ ID NO: 455812 - DNA, 496 bp, Homo sapiens; identical to SEQ ID NO: 446296
  misc_feature: HEFZJCU01ATPO0.3.26.C04.1.454.heavy.3.raw

SEQ ID NO: 455813 - DNA, 535 bp, Homo sapiens
  misc_feature: HEFZJCU01CPDRF.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttattggggccagggagccctggtctaccg

SEQ ID NO: 455814 - DNA, 500 bp, Homo sapiens; identical to SEQ ID NO: 448262
  misc_feature: HEFZJCU01ER4EL.7.85.H08.1.454.heavy.3.raw

SEQ ID NO: 455815 - DNA, 518 bp, Homo sapiens; identical to SEQ ID NO: 444718
  misc_feature: HEFZJCU01AOHIE.9.34.D01.1.454.heavy.3.raw

SEQ ID NO: 455816 - DNA, 481 bp, Homo sapiens; identical to SEQ ID NO: 445517
  misc_feature: HEFZJCU01BV317.22.36.D03.1.454.heavy.3.raw

SEQ ID NO: 455817 - DNA, 532 bp, Homo sapiens
  misc_feature: HEFZJCU01CS5VF.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaatgaacagcctgagaaccgaggacacagccgtgtattactgtaccacatccctgaaagcgtcaactactactactacgtatggacctctgggaccg

SEQ ID NO: 455818 - DNA, 526 bp, Homo sapiens
  misc_feature: HEFZJCU01EDYV4.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaaccctggtcaccgtctccccaccctccaacccg

SEQ ID NO: 455819 - DNA, 470 bp, Homo sapiens; identical to SEQ ID NO: 444866
  misc_feature: HEFZJCU01BGGGW.4.36.D03.1.454.heavy.3.raw

SEQ ID NO: 455820 - DNA, 541 bp, Homo sapiens
  misc_feature: HEFZJCU01BEFUD.16.39.D06.1.454.heavy.3.raw
tgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttattgaaatgatggtgacacaatctacgccgactccgtgaagggccgattcaccatctccagagacaattccaagaacacggtgaatcttcaaatgaacagcctgagaaccgaggacacggccgtatattattgtataggttatggtggtaattcgggccctggggccagggaaccgtggtcaccgtctcctcagcctccaccg

SEQ ID NO: 455821 - DNA, 509 bp, Homo sapiens
  misc_feature: HEFZJCU01DTK8I.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaaggcctggagtggcttgtgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactgggccagggaactctggtcaccgtctccgcagcctccaccaaggccc

SEQ ID NO: 455822 - DNA, 477 bp, Homo sapiens; identical to SEQ ID NO: 444659
  misc_feature: HEFZJCU01BYJHO.16.10.A10.1.454.heavy.3.raw

SEQ ID NO: 455823 - DNA, 518 bp, Homo sapiens; identical to SEQ ID NO: 445423
  misc_feature: HEFZJCU01B9O4I.7.78.H01.1.454.heavy.3.raw

SEQ ID NO: 455824 - DNA, 383 bp, Homo sapiens; identical to SEQ ID NO: 444673
  misc_feature: HEFZJCU01B47QU.11.61.F06.1.454.heavy.3.raw

SEQ ID NO: 455825 - DNA, 525 bp, Homo sapiens
  misc_feature: HEFZJCU01B854M.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcctgacttctggggccatggaacccggtcc

SEQ ID NO: 455826 - DNA, 512 bp, Homo sapiens
  misc_feature: HEFZJCU01CQSWR.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctccccagcctccaccaagggcccatcggtcttccccctggcaccctcctccaagagcacctctgggggcacagcggccctggctgcctggtcaggactactccgtactagacg

SEQ ID NO: 455827 - DNA, 508 bp, Homo sapiens
  misc_feature: HEFZJCU01BYDA9.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttggaggacacggctgtttattactgtacgaaaggaggggggatacagtggcagctccaagtactta

SEQ ID NO: 455828 - DNA, 503 bp, Homo sapiens
  misc_feature: HEFZJCU01A6L2P.52.20.B09.1.454.heavy.3.raw
cgcagtacgacacgaccggtgctcgatttagtgtagtgtgaaggggctgggagacgagcccagcactggaagtcgccggtgtttccattcggtgatcatcactgaacacagaggactcaccatggagtttgggctgagctgggttttcctcgttgctcttttaagaggcgtccagtgttatgtgcagctggtggagtctgggggaggcgtggtccagcctgggaggtccctgagactcgcctgtaaaccgtccggatttaccttcagtaactatgcaatgcactgggtccgccaggctccaggcaaggggctggactgggtggcagctatatcatttgatggaagcaataaatactacgcagactccgtgaagggccgattcaccatttccagagacagctccgataacacggtctatctgcgaatgaacagcctgagacctgaggacacggctctttttactgttgcgccaggaagcagtggctggccacatgatgcttttt

SEQ ID NO: 455829 - DNA, 372 bp, Homo sapiens; identical to SEQ ID NO: 444513
  misc_feature: HEFZJCU01D7IQV.5.23.C01.1.454.heavy.3.raw

SEQ ID NO: 455830 - DNA, 437 bp, Homo sapiens; identical to SEQ ID NO: 447018
  misc_feature: HEFZJCU01BMPE3.40.27.C05.1.454.heavy.3.raw

SEQ ID NO: 455831 - DNA, 516 bp, Homo sapiens
  misc_feature: HEFZJCU01CYO89.53.36.D03.1.454.heavy.3.raw
  modified_base (461)..(461): a, c, t, g, unknown or other
cgcgtatacacacgaccggtgctcgatttagctgcgtcacgatctctcttgggggctctgggagaggagccccagccgtgagattcccaggagtttccacttggtgatcagcactgaacacagaccaccaaccatggagtttgggcttagctgggttttccttgttgctattttaaaaggtgtccaatgtgaggtggaactggtggagtctgggggaggcttggttcagccagggcggtccctgagactctcctgtacaacttcaggattcacctttggtgattatgctatgacctgggtccgccaggctccagggaaggggctggagtgggtaggtttcgttagaagcaaactgatggtgggacaacagaatacgccgcgtctgtgaaaggcagatttatcatctcaagagatgattccagaggcatcgcctatctgcaaatgaacagcctgaaaaccgnggacacagccgtgtatttctgtaactagagtcttctttgtatttactatgatact

SEQ ID NO: 455832 - DNA, 499 bp, Homo sapiens; identical to SEQ ID NO: 447792
  misc_feature: HEFZJCU01EEGIB.17.10.A10.1.454.heavy.3.raw

SEQ ID NO: 455833 - DNA, 503 bp, Homo sapiens; identical to SEQ ID NO: 450415
  misc_feature: HEFZJCU01BP7E8.15.55.E11.1.454.heavy.3.raw

SEQ ID NO: 455834 - DNA, 530 bp, Homo sapiens
  misc_feature: HEFZJCU01C9N5C.49.43.D10.1.454.heavy.3.raw
agtcgagagacacgaccggtgctcgatttagactagcagtaaggggctgagagaggagcccagccctgggattttcaggtgttttcatttggtgatcaggactgaacagagagaactcaccatggagtttgggctgagctggcttttcttgtggctattttaaaaggtgtccactgtgaggtgcaactgttggaatctgggggagacttggtaaagccgggggggtccctgagactctcctgtgcagtctcgggattcacctttagagtctatgccatgcactgggttcgccaggccccagggaaggggctggagtgggtctctgccattagtggaagtggtgatctcagatactacggagactccgtgaagggccggttcaccatctccagagacaactccaagaatacgctctatctacacatgaaaaacctaagagccgacgacacggccgtctattactgtgcaaagtgggtcacgggactacgatgatactagtggctattactccggtgactactttgacttac

SEQ ID NO: 455835 - DNA, 510 bp, Homo sapiens
  misc_feature: HEFZJCU01EDWJQ.4.67.G01.1.454.heavy.3.raw
agcactgtagcacgaccggtgctcgatttagagtatacatattgggtttggggtctgagagtggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggttccggcggtccggggt

SEQ ID NO: 455836 - DNA, 399 bp, Homo sapiens
  misc_feature: HEFZJCU01DWFK9.4.77.G11.1.454.heavy.3.raw
agcactgtagcacgaccggtgctcgatttagctagtcactcaagggaaggggctggaatggctttcatacattactagcagtggtacagcatactacgcagagtctctgcagggccgattcaccatctccagggacaacgccaagaactcgctatatctggaaatgaacagcctgagagtcgaggacacggccctgtattactgtgcgagagaccgaggaagggcagtggctggatccgttagggtttttgacaactggggacagggaaccctggtcaccgtctcctcggcctccaccaagggcccatcggtcttccccctggcgccctgctccaggagcacctctgagagcacagcggccctgggctgcctggtcaaggactacttccctacagtgct

SEQ ID NO: 455837 - DNA, 505 bp, Homo sapiens
  misc_feature: HEFZJCU01ANEAQ.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgaggggccgattcaccatctccagagacgattccaagaacacgttgtatcttcaatgaacagcctgacagtcgacgacacggccatgtattttgtgcgagcgacccggggctcctcaatggctttcattacg

SEQ ID NO: 455838 - DNA, 516 bp, Homo sapiens; identical to SEQ ID NO: 447339
  misc_feature: HEFZJCU01EERRV.46.67.G01.1.454.heavy.3.raw

SEQ ID NO: 455839 - DNA, 390 bp, Homo sapiens
  misc_feature: HEFZJCU01ATY5V.16.24.C02.1.454.heavy.3.raw
tgtactactccacgaccggtgctcgatttagtacagatcgttagggaaggggctggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctggcaccctcctccaagagcacctctgggggcacagcggccctgggctgcctggtcaaggactacttccgagtagtaca

SEQ ID NO: 455840 - DNA, 468 bp, Homo sapiens
  misc_feature: HEFZJCU01DNLI7.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctcaccaagggcccatcgtcttcccctggcgccctgctccaggagcacctccgagagcacagcggccctgggctgcctggtcaaggactacttccctacagtgct

SEQ ID NO: 455841 - DNA, 523 bp, Homo sapiens
  misc_feature: HEFZJCU01CV5GU.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaagggaggggggaaccaggcgggagttccaagtactcctttgacgtcgtcggggccgtac

SEQ ID NO: 455842 - DNA, 508 bp, Homo sapiens; identical to SEQ ID NO: 446002
  misc_feature: HEFZJCU01EMBHV.9.78.H01.1.454.heavy.3.raw

SEQ ID NO: 455843 - DNA, 501 bp, Homo sapiens
  misc_feature: HEFZJCU01B6AFJ.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagttttgggctgagcgtgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtggggtggcgattatatcacatgatggaactaatagacgctatgccgactccgtgaagggccgattcaccatctccagagacaattccaagaacacgcagtatctgcaaatgaacagcctgagagctgaggacgacggctgttgtattactggtgggagagatgggaggtcgaatattgta

SEQ ID NO: 455844 - DNA, 502 bp, Homo sapiens
  misc_feature: HEFZJCU01E1Q9V.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtatttactgtgcgagactggccgcaacagactacggtggcaactcctatgcttttgatatctggggccaaggggac

SEQ ID NO: 455845 - DNA, 491 bp, Homo sapiens; identical to SEQ ID NO: 446104
  misc_feature: HEFZJCU01BWCVB.3.34.D01.1.454.heavy.3.raw

SEQ ID NO: 455846 - DNA, 384 bp, Homo sapiens; identical to SEQ ID NO: 444454
  misc_feature: HEFZJCU01CNA7A.11.61.F06.1.454.heavy.3.raw

SEQ ID NO: 455847 - DNA, 496 bp, Homo sapiens
  misc_feature: HEFZJCU01EGIVD.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagttgagcagcctgagatctgacgacacggccgttttatactgtgcgcgagataatagtcacaactggaacggcggttttggggt

SEQ ID NO: 455848 - DNA, 507 bp, Homo sapiens
  misc_feature: HEFZJCU01ARRED.3.17.B06.1.454.heavy.3.raw
  modified_base (455)..(455): a, c, t, g, unknown or other
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctganaaccgacgacacggccgtctattattgtgtcatagacctaggatacaacgac

SEQ ID NO: 455849 - DNA, 513 bp, Homo sapiens; identical to SEQ ID NO: 446452
  misc_feature: HEFZJCU01DIXC5.17.33.C11.1.454.heavy.3.raw

SEQ ID NO: 455850 - DNA, 501 bp, Homo sapiens; identical to SEQ ID NO: 445341
  misc_feature: HEFZJCU01D52E1.48.34.D01.1.454.heavy.3.raw

SEQ ID NO: 455851 - DNA, 540 bp, Homo sapiens
  misc_feature: HEFZJCU01A9KUB.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgctgctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatcccctgaaagcgtcaactactactactacggtatggacctctggggccaagggaccg

SEQ ID NO: 455852 - DNA, 373 bp, Homo sapiens; identical to SEQ ID NO: 445532
  misc_feature: HEFZJCU01EMWVB.7.37.D04.1.454.heavy.3.raw

SEQ ID NO: 455853 - DNA, 506 bp, Homo sapiens
  misc_feature: HEFZJCU01ADTE9.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgatccggtgagcctacggcagcggcctttgactttcgtc

SEQ ID NO: 455854 - DNA, 480 bp, Homo sapiens
  misc_feature: HEFZJCU01BF0WM.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctgtcaccgtctcctcagcctccaccaagggcccatcggtctcccctggcaccctcctccaagagcacctctggggcacagcggccctgggctgcctggtcaaggactacgttcctagagacacg

SEQ ID NO: 455855 - DNA, 536 bp, Homo sapiens
  misc_feature: HEFZJCU01B7AG2.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaaggggctggagtgggtctctactattactgctagtggtaatcatgcatactatgcagactccgtgaagggccggttcaccttcaccagagacaattccaagaacacgctctatctgcaattgaccagcctgagcgccgaggacacggccactgtattactagtactaaactcgtcgggtggccgcggccggtaccgtcggactggtttggattttctggggtccaagggtacg

SEQ ID NO: 455856 - DNA, 505 bp, Homo sapiens
  misc_feature: HEFZJCU01C6H54.51.28.C06.1.454.heavy.3.raw
cgatcgtatacacgaccggtgctcgatttagagctcacgtattgggtttggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtgcagtatatcctatgatggaagcaataagcactacgcagagtccgtgaagggccgattgaccatctccagagacaactcgaagaatacggttcttctacaatagaacagcctgagagctggaggacgacggctatgttttactgttgcgaggagggaactcgattacagtcacg

SEQ ID NO: 455857 - DNA, 526 bp, Homo sapiens
  misc_feature: HEFZJCU01DGDIY.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggattcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctggggccaggggaccctggtcatcgtctccccagcctccaccaagggcccatcggtcttccccctggcgccctcg

SEQ ID NO: 455858 - DNA, 489 bp, Homo sapiens
  misc_feature: HEFZJCU01DBX41.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgcctgctccaggagcacctccgagagcacagcggccgtggctgcctggtcaaggactacttcccacgagagta

SEQ ID NO: 455859 - DNA, 507 bp, Homo sapiens; identical to SEQ ID NO: 445781
  misc_feature: HEFZJCU01AS89J.48.44.D11.1.454.heavy.3.raw

SEQ ID NO: 455860 - DNA, 511 bp, Homo sapiens
  misc_feature: HEFZJCU01CII53.52.39.D06.1.454.heavy.3.raw
cgcagtacgacacgaccggtgctcgatttagtgacatctcgcagttctttggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgcccctcacctgcattgtgtctggtggctccatcagcagtggtactttttactacagttggagtcgccagcccccagggaagggactagagtggattgggagtgttcatcataatgggaggaccttctacagcccgtccctcaagagccgagtcaccatatcaatggacacgtccaggaaccacctctccctgaacctcaactctgttacggccgcggacacggccgtgtattattgtgcgagggaggcccaaaatggtggcgactcgccttcacttgacctctggggccagggaaggcgtggtcatcgt

SEQ ID NO: 455861 - DNA, 533 bp, Homo sapiens
  misc_feature: HEFZJCU01B55XP.53.10.A10.1.454.heavy.3.raw
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgcttggtctcgtcagttggtcaatccgccctccaggggggacctttgggggtttcgaccccgttgggggccctaggggaaccctggtcaccgtctcctcagcctccaccaagggcccatccggtcttcccctggcaccctcctccaagagcacctcg

SEQ ID NO: 455862 - DNA, 504 bp, Homo sapiens
  misc_feature: HEFZJCU01EAQT8.48.37.D04.1.454.heavy.3.raw
agtatacatacacgaccggtgctcgatttagtagcatactgttgggtttggggatgctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagcccccgggaaggactggaatggattgggagtatctattatacagggagcacctactacaacccgtccctcaagagtcgagtcaccatctccgcagacacgtccaagaaccaattctccctgaagctgagctctgtgaccgccgcagacacggctgtctattactgtgcgaggccccgagcgcagtggtcttttgatgcctttgatatggtgggccaagggacaatggtcaccgt

SEQ ID NO: 455863 - DNA, 535 bp, Homo sapiens
  misc_feature: HEFZJCU01C7XUS.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttattggggccaggggagccctggtcaccg

SEQ ID NO: 455864 - DNA, 516 bp, Homo sapiens
  misc_feature: HEFZJCU01CE7OD.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttccccctggcaccctcctccaagagcacctctgggggcacagcggcctgggctgcctggtcaggactacttccagacgtatca

SEQ ID NO: 455865 - DNA, 506 bp, Homo sapiens; identical to SEQ ID NO: 445864
  misc_feature: HEFZJCU01CSJ7G.13.37.D04.1.454.heavy.3.raw

SEQ ID NO: 455866 - DNA, 501 bp, Homo sapiens
  misc_feature: HEFZJCU01CNJA8.3.71.G05.1.454.heavy.3.raw
agacgcactccacgaccggtgctcgatttagtgtcgtcgcaagagagaggggctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcgaggtattacttggaatagtgataacatcggctatgcggactctgtgaagggccgattcaccatctccagagacaacgccaagaactccctgtatctgcaaatgaacagtctgagacctgaggacacggccttagtattactgtgtaaagtcccggggaaatatagtacg

SEQ ID NO: 455867 - DNA, 484 bp, Homo sapiens
  misc_feature: HEFZJCU01CWQ2J.52.19.B08.1.454.heavy.3.raw
cgcagtacgacacgaccggtgctcgatttagtgagtcagtaagggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtctgggggaggcgtggtccagcctgggaggtccctgagactctcttgtgctgcctctggattcaccttcagggtctatgacatgcactgggtccgccagctccaggcaaggggctgggagtgggtggcatttatatcatatgatggaagcaagatatactatgtagactccgtgaagggccgattcatcatctccagagacaactccgagaacacgctgtatctgcaaatgatcaggctgagagctgaagacacggctttatattactgtgcgaacttaatcaac

SEQ ID NO: 455868 - DNA, 508 bp, Homo sapiens; identical to SEQ ID NO: 444619
  misc_feature: HEFZJCU01B0PHD.3.81.H04.1.454.heavy.3.raw

SEQ ID NO: 455869 - DNA, 498 bp, Homo sapiens
  misc_feature: HEFZJCU01C1DD6.12.14.B03.1.454.heavy.3.raw
atacgacgtacacgaccggtgctcgatttagtgtgagtagttccgcgggggggggaggcttggttcggcctagcgggtccctgagactctcctgcgcagcctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaaggggctctggttcagggatagggctttgactcctgggcccagggaaccctggtcgcggtctcctcagcctccaccaagggcccatcggtcttccccctggcaccctcctccaagagcacctctgggggcacagcggcctgggctgcctggtcaaggactacttcctacgtcgtat

SEQ ID NO: 455870 - DNA, 502 bp, Homo sapiens
  misc_feature: HEFZJCU01AXHLM.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtctttttgatgcctttgatatgtggggccaagggacaatggtcaccgtcttc

SEQ ID NO: 455871 - DNA, 530 bp, Homo sapiens
  misc_feature: HEFZJCU01BDVR6.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaagggctggagtgggttggccgtattaaaaccaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatcccctgaaagcgtcaactactactactacggtatggacctcg

SEQ ID NO: 455872 - DNA, 375 bp, Homo sapiens; identical to SEQ ID NO: 445125
  misc_feature: HEFZJCU01DOZQO.9.53.E09.1.454.heavy.3.raw

SEQ ID NO: 455873 - DNA, 523 bp, Homo sapiens
  misc_feature: HEFZJCU01E0C4E.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggcgattcaccatctccagagacaactccaggaacacaatgtatttggacctgaacagcctaagtcctgaggacacgggtgtatactactgtacgaaggaggggggaaccaggcgggagttccaagtactcctttgacgtctc

SEQ ID NO: 455874 - DNA, 495 bp, Homo sapiens
  misc_feature: HEFZJCU01CC65M.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctgacgacacggccgtgtattactgtgcgagaggttttagtgatacttatgtagtggtggtacctgctactttttc

SEQ ID NO: 455875 - DNA, 529 bp, Homo sapiens; identical to SEQ ID NO: 446480
  misc_feature: HEFZJCU01B503U.18.33.C11.1.454.heavy.3.raw

SEQ ID NO: 455876 - DNA, 501 bp, Homo sapiens
  misc_feature: HEFZJCU01DQC26.48.71.G05.1.454.heavy.3.raw
agtatacatacacgaccggtgctcgatttagtgtcgtcgcaagagagaggggacaaccacattcctcctctaaagaagtccctgggagcacagctcttcaccatggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcatccctatgtttaagagaatcaggcgtgctgagaagttcgaggacagagtcacctttatggcggacgaatcctcgagcacagtctatatggatctggccagcctgaagtctgaagacacggggcatatatttctgtgcgacagatgggtcgtggattctcgtctgcttatggaggggaagactggttcg

SEQ ID NO: 455877 - DNA, 505 bp, Homo sapiens; identical to SEQ ID NO: 444759
  misc_feature: HEFZJCU01CJCOP.10.38.D05.1.454.heavy.3.raw

SEQ ID NO: 455878 - DNA, 392 bp, Homo sapiens; identical to SEQ ID NO: 444456
  misc_feature: HEFZJCU01CK3RI.7.60.F05.1.454.heavy.3.raw

SEQ ID NO: 455879 - DNA, 521 bp, Homo sapiens
  misc_feature: HEFZJCU01EQY88.10.85.H08.1.454.heavy.3.raw
  modified_base (468)..(468): a, c, t, g, unknown or other
catagtagtgcacgaccggtgctcgatttagtatcactcagtcgcggggagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgngaggggagccggctagtggttcggaccttcgtggggccaaggggaaccctggt

SEQ ID NO: 455880 - DNA, 489 bp, Homo sapiens
  misc_feature: HEFZJCU01C53BE.13.71.G05.1.454.heavy.3.raw
tcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcatcgttgctcttttaagaggtgtccagtgtcaggtgcagctggtggaatctgggggaggcgtggtccagcctggggaatccctgacactgtcttgtgtagcctctggattcagcttcagaacctatggcatgcactgggtccgccaggccccaggcaaggggctggagtggctgactcttttatcatatgatggaagtcaaaaattctatgcagactccgtgaagggccgattcaccgtctccagggacaactccaagaacaccttatatctgcagatgaacagcctgagaggtgacgactcggctgtatacttctgtgcgacaaacatgatgtttggagtggatgt

SEQ ID NO: 455881 - DNA, 502 bp, Homo sapiens
  misc_feature: HEFZJCU01CG395.9.33.C11.1.454.heavy.3.raw
tgatacgtctcacgaccggtgctcgatttagagtgagctcgttgggtttgggggcgtgatccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgccctgctccaggagcacctccgagagcacagcggccctgggctgcctggtcaaggactacttccagacgtata

SEQ ID NO: 455882 - DNA, 503 bp, Homo sapiens; identical to SEQ ID NO: 445995
  misc_feature: HEFZJCU01D5WUX.17.25.C03.1.454.heavy.3.raw

SEQ ID NO: 455883 - DNA, 507 bp, Homo sapiens
  misc_feature: HEFZJCU01B3HMR.14.21.B10.1.454.heavy.3.raw
cgtctagtaccacgaccggtgctcgatttagtgtcgtcgcaggagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagatttttggagttggttattatacctttgacttcg

SEQ ID NO: 455884 - DNA, 384 bp, Homo sapiens; identical to SEQ ID NO: 444454
  misc_feature: HEFZJCU01BKEY0.11.61.F06.1.454.heavy.3.raw

SEQ ID NO: 455885 - DNA, 480 bp, Homo sapiens; identical to SEQ ID NO: 444657
  misc_feature: HEFZJCU01DO7XS.19.67.G01.1.454.heavy.3.raw

SEQ ID NO: 455886 - DNA, 435 bp, Homo sapiens; identical to SEQ ID NO: 447528
  misc_feature: HEFZJCU01DW0NH.9.30.C08.1.454.heavy.3.raw

SEQ ID NO: 455887 - DNA, 518 bp, Homo sapiens
  misc_feature: HEFZJCU01A20QM.26.71.G05.1.454.heavy.3.raw
agactatactcacgaccggtgctcgatttagtgtcgtcgcaagagagagggggggggaagaggaagactgacggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagaatatgactattggggccagggaattttggtcaccgtctccccagcctccaccaagggcccatcggtcttccccctggcgccctgctccaggagcacctccgagagcaccagcggccctgggctgcctggtcaaggactacttcc

SEQ ID NO: 455888 - DNA, 503 bp, Homo sapiens
  misc_feature: HEFZJCU01A6BZY.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctcctgaagctgagggctgtgagcgccgcagacacggccgtggtattactgtgcgagactggccgcaacagactacggtggcaacgtcctatgcttttgactatctggggccaaggggac

SEQ ID NO: 455889 - DNA, 496 bp, Homo sapiens
  misc_feature: HEFZJCU01BHEAM.53.80.H03.1.454.heavy.3.raw
cgcgtatacacacgaccggtgctcgatttagctgtgcgtcgaagggaaagggggagcatcacccagcaaccacatcctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgcaaggaacagcataatgactcgtccccggacttt

SEQ ID NO: 455890 - DNA, 489 bp, Homo sapiens
  misc_feature: HEFZJCU01EXMOV.4.28.C06.1.454.heavy.3.raw
  modified_base (440)..(440): a, c, t, g, unknown or other
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccgggacctggtcaccgtctcctcggcctccaccaagggcccatcggtcttcccctggcgccctgctccaggagcacctccganagcacagcggccctgggctgcctggtcaggactacttccctacagtgct

SEQ ID NO: 455891 - DNA, 503 bp, Homo sapiens
  misc_feature: HEFZJCU01D2WAC.48.37.D04.1.454.heavy.3.raw
agtatacatacacgaccggtgctcgatttagtagcatactgttgggtttggggagctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgaggacacggctgtttattactgtgcgagagtgcggatttcacctacacg

SEQ ID NO: 455892 - DNA, 485 bp, Homo sapiens; identical to SEQ ID NO: 446198
  misc_feature: HEFZJCU01DPNTK.47.55.E11.1.454.heavy.3.raw

SEQ ID NO: 455893 - DNA, 515 bp, Homo sapiens
  misc_feature: HEFZJCU01EIXD4.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggccccatcggtcttcccctggcgccctgctccaggagcaccg

SEQ ID NO: 455894 - DNA, 526 bp, Homo sapiens
  misc_feature: HEFZJCU01AY85R.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgctttgatatctggggccaagggacaatggtcaccgtctcttcagcctccaccaacggcccatcggtccttcccctcggccaccctcctccaacgacgcacctcgtggggggcacgacggccggcccgg

SEQ ID NO: 455895 - DNA, 396 bp, Homo sapiens; identical to SEQ ID NO: 444469
  misc_feature: HEFZJCU01C2YJ9.47.46.E02.1.454.heavy.3.raw

SEQ ID NO: 455896 - DNA, 507 bp, Homo sapiens
  misc_feature: HEFZJCU01A913V.48.41.D08.1.454.heavy.3.raw
agtatacatacacgaccggtgctcgatttagtcacgcgagaaagggaaagggggctctgagagaggagccttagccctggattccaaggcctatccacttggtgatcagcactgagcaccgaggattcaccatggaactggggctccgctgggttatccttgttgctattttagaaggtgtccagtgtgaggtgcagctggtggagtcagggggaggcctggtcaagcctggggggtccctgagactctcctgtgcagcctctggattcaccttcagtacctataccatgaactgggtccgccaggctccagggaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagaggtgggaccttacg

SEQ ID NO: 455897 - DNA, 498 bp, Homo sapiens
  misc_feature: HEFZJCU01D14SR.19.86.H09.1.454.heavy.3.raw
tactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaaggcccatcggtcttcccctggcgccctgctccaggagcacctccgagagcacagcggccctggctgcctggtcaaggactacttcccacgagagta

SEQ ID NO: 455898 - DNA, 514 bp, Homo sapiens
  misc_feature: HEFZJCU01CHUHN.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactggggccagggaacccctggtccgtcccg

SEQ ID NO: 455899 - DNA, 499 bp, Homo sapiens
  misc_feature: HEFZJCU01DG1SH.12.38.D05.1.454.heavy.3.raw
atacgacgtacacgaccggtgctcgatttagtatctgatagttgggtttgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagagcacagcggccctgggctgcctggtcaaggctacttcctacgtcgtat

SEQ ID NO: 455900 - DNA, 515 bp, Homo sapiens
  misc_feature: HEFZJCU01CIYVC.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggcccatcggtcttccccctggcgccctcgctccacggagcga

SEQ ID NO: 455901 - DNA, 498 bp, Homo sapiens
  misc_feature: HEFZJCU01DUFRY.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttccccctggcaccctcctccaacgagcacctctgggggcacagcggccctgggctgcctggtcaaggactacttccgagtagtaca

SEQ ID NO: 455902 - DNA, 530 bp, Homo sapiens
  misc_feature: HEFZJCU01C787U.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatgggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaagggccatcggtcttcccctggcaccctcctccaagagcacctctgggggcacagcggcctgggctgcctc

SEQ ID NO: 455903 - DNA, 382 bp, Homo sapiens
  misc_feature: HEFZJCU01B8D5R.19.80.H03.1.454.heavy.3.raw
tactctcgtgcacgaccggtgctcgatttagctgtgcgtcgaagggaaaggggctggagtgggtggccaacataaagccagatggaagtgagagatcttatgtggactctgtgaagggccgattcagcatctccagagacaacgccaagaattcactgtttctgcaaataaacagcctgagagccgaggacacggctgtctactattgtgtgagagaggataagaatacttttgatttctggggccaggggacaacggtcaccgtctcttcagcctccaccaagggcccatcggtcttccccctggcgccctgctccaggagcacctccgagagcacagcggccctgggctgcctggtcaaggactacttcccacgagagta

SEQ ID NO: 455904 - DNA, 485 bp, Homo sapiens
  misc_feature: HEFZJCU01CXIZI.51.76.G10.1.454.heavy.3.raw
cgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcccgggaggtccctgagactctcctgtgcagcctctggattcaccttcagtgcctatggcatgcactgggtccgccaggctccaggcaaggggctggagtgggtggcatttatatcagatgatggcagtaataaagagtatgcagtctccgtgaagggccgattcaccatctccagagacaattcccagaacacactgtatctgcaaatgaacagattgagagctgaggacacggctgtgtatttctgtgcgaaacgctatgagtgggta

SEQ ID NO: 455905 - DNA, 503 bp, Homo sapiens; identical to SEQ ID NO: 445995
  misc_feature: HEFZJCU01CVZH9.17.25.C03.1.454.heavy.3.raw

SEQ ID NO: 455906 - DNA, 480 bp, Homo sapiens
  misc_feature: HEFZJCU01EPZ45.53.15.B04.1.454.heavy.3.raw
cgcgtatacacacgaccggtgctcgatttagacagtatatatccgcgggggctctgggagaggagcccagcactagaagtcggcggtgtttccattcggtgatcagcactgaacacagaggactcagcatggagtttgggctgagctgggttttcctcgttgctcttttaagaggtgtccagtgtcaggtgcaactggtggagtctgggggaggcgtggtccagcctgggaagtcactgcgactctcctgtgcagcctctggattcagcttcagctcgtatgcgatgcactgggtccgccaggctccaggcaaggggctggagtgggtggcggttatttcacatgatggaagtcaggaatattatgcagactccgtgaggggccgattcaccatctcccgagacaattccaagaacacagtggatctgcaaatgagtagcatgagagttggggacacggcggtgtattactgtgcgaagg

SEQ ID NO: 455907 - DNA, 527 bp, Homo sapiens
  misc_feature: HEFZJCU01C4HGB.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgttgcgagagatggggcccacgaacgttactacgctatggacgtctggggccaaggggacctac

SEQ ID NO: 455908 - DNA, 507 bp, Homo sapiens
  misc_feature: HEFZJCU01AFKWA.14.23.C01.1.454.heavy.3.raw
cgtctagtaccacgaccggtgctcgatttagtacacgtgattagggattggggccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcactttcagcacctatgctatcaactgggtgcgacaggcccctggacaagggcttgagtggatgggaggaatcatccctatgtttggtacaactaactacacacagaagttccagggcagagtcacgattaccgcggacgaatcccacgagcacagcctacatggagctgagcagcctgagatctgacgacacggccgtgtattactgtgcgagggccttcggttcgtcagtgcctggttgagacgtggggccgagggaactcgtcggtcaccgtcctcctcacgcctccaccg

SEQ ID NO: 455909 - DNA, 527 bp, Homo sapiens
  misc_feature: HEFZJCU01DI0Z0.11.25.C03.1.454.heavy.3.raw
cgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccac

SEQ ID NO: 455910 - DNA, 500 bp, Homo sapiens
  misc_feature: HEFZJCU01CFMXZ.7.85.H08.1.454.heavy.3.raw
cgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccagggaagggctgcagtgggtttcacacattaatactggaagtaggaccataacttacacagactctgtgaagggccgattcaccacctccagagacgacgccaagaactcactgtctctgcaaatgaacagcctgagagtcgaggacacggctgtgtattactgtgcgagagatccgggaggggacgtatgacc

SEQ ID NO: 455911 - DNA, 548 bp, Homo sapiens
  misc_feature: HEFZJCU01A5WQB.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgtacgttttggggccgacgggaaaccgtggtcgacccgttcctccccacgccttcccaccgaacggggcccacgtccggttcctttccccccg

SEQ ID NO: 455912 - DNA, 500 bp, Homo sapiens
  misc_feature: HEFZJCU01BZQSO.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacgtggtttggggctacgtggggccaggggaaccctggtccaccgtctcctcagcctccaaccg

SEQ ID NO: 455913 - DNA, 519 bp, Homo sapiens
  misc_feature: HEFZJCU01EMIA1.47.78.H01.1.454.heavy.3.raw
agctcacgtacacgaccggtgctcgatttagtgtgagtagtttgggtttggggctctctgagagtcagggacctcctgcattagcacatgaaacacctgtggttcttccgcctcctggtgacagctcccagatttgactgcctcaggaatgccgatttgaagatgtgagatgctgcctctgatcccaggactcactgcgggtttctctgttcacaggggtcctgtcccaggtgcaaccacaccactggggcgcaggactgttgaagccttcggagaccctgtccctcacctgcgctgtctgtggtgggtccttcagtgactactactgagactagatccgccagtccccagggaaggggctggaatggattcgacaggtcaatcattacagatccaccaactacaacccgtccctcagcagtcgagtcactttcgcttgacacgtccaacaaccagttttctctgaatcaaaacccgagaccgccgcggacagcctcgcccctggggcccagaaacccg

SEQ ID NO: 455914 - DNA, 509 bp, Homo sapiens
  misc_feature: HEFZJCU01EZ6GL.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacggccaggcggccttttgactttcgtc

SEQ ID NO: 455915 - DNA, 486 bp, Homo sapiens; identical to SEQ ID NO: 454595
  misc_feature: HEFZJCU01D85KD.16.12.B01.1.454.heavy.3.raw

SEQ ID NO: 455916 - DNA, 472 bp, Homo sapiens
  misc_feature: HEFZJCU01D3I13.51.37.D04.1.454.heavy.3.raw
cgatcgtatacacgaccggtgctcgatttagtagcatactgttgggtttggggagctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatatta

SEQ ID NO: 455917 - DNA, 530 bp, Homo sapiens
  misc_feature: HEFZJCU01DLIM7.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactacgtgggggttcgaccccgtgggggccaggggaaccctggtcaccgtctcctcagcctccaccg

SEQ ID NO: 455918 - DNA, 502 bp, Homo sapiens; identical to SEQ ID NO: 445538
  misc_feature: HEFZJCU01DHALY.17.10.A10.1.454.heavy.3.raw

SEQ ID NO: 455919 - DNA, 531 bp, Homo sapiens
  misc_feature: HEFZJCU01AV847.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggcccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctcaccaaggg

SEQ ID NO: 455920 - DNA, 507 bp, Homo sapiens
  misc_feature: HEFZJCU01CBTZ8.48.2.A02.1.454.heavy.3.raw
agtatacatacacgaccggtgctcgatttagactcatctacaggggtcagagaggagccttagccctggactccaaggcctttccacttggtgatcagcactgagcacagaggactcaccatggaattggggctgagcgtggtttcgtgttaggctatttagaaggtgtccagtgtgaggagcagctggtggagtctgggggaggcttggtccagcctggggggtccctgagactctcctgtgttgcctctgggttcacatttcgtaacaattggatgacctgggtccgccaggctccagggaaggggctggagtgggtggccaatataaaccgagatggaaataagatatactatgtggactctgttaagggccgattcatcatctccagagacaacgccaagagttcactgtttctgcaaatgagcagcctgagagccgaggacacggctctatatttactgtacgagagatttcagcccctcccaaagttgggaaatttattaa

SEQ ID NO: 455921 - DNA, 473 bp, Homo sapiens
  misc_feature: HEFZJCU01D3PAP.4.14.B03.1.454.heavy.3.raw
agcactgtagcacgaccggtgctcgatttagtgtgagtagttccgcggggatcactcaacaaccacatctgtcctctagagaaaaccctgtgagcacagctcctcaccatggactggacctggaggatcctcttcttggtggcagctgctacaagtgcccactcccaggtgcagctggtgcagtctggggctgaggtgaagaagcctggggcctcagtgaaggtctcctgcaagacttctggatacaccttcaccagttatgatatccactgggtgcgacaggcctctggacaagggcttgagtggatgggatgggatgaacccaaacactggtgccacaggctatgcacagaggttccagggcagagtcaccatgaccagggacacctccataaggacagcctacatggagctgagcagcctcagatctgacgacacggccgtgtattactgtgcgaggcgcgaaggactaa

SEQ ID NO: 455922 - DNA, 521 bp, Homo sapiens
  misc_feature: HEFZJCU01BE09L.2.11.A11.1.454.heavy.3.raw
acgctcgacacacgaccggtgctcgatttagctacgactgcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggcctcgggggctactggggccagggaaccgatggtcaccgtcgtcctcagcctccaccaagggcccatcggtcttcccctcggcaccctcctccaagagcacctctgggggcacagcggccctgggctgcctggtcaaggactacttcctgtcgagcgt

SEQ ID NO: 455923 - DNA, 379 bp, Homo sapiens; identical to SEQ ID NO: 444450
  misc_feature: HEFZJCU01DWK0V.47.77.G11.1.454.heavy.3.raw

SEQ ID NO: 455924 - DNA, 523 bp, Homo sapiens
  misc_feature: HEFZJCU01EC619.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctgggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgcctgctccaggagcacctccgag

SEQ ID NO: 455925 - DNA, 384 bp, Homo sapiens; identical to SEQ ID NO: 445394
  misc_feature: HEFZJCU01CB8IH.22.46.E02.1.454.heavy.3.raw

SEQ ID NO: 455926 - DNA, 498 bp, Homo sapiens
  misc_feature: HEFZJCU01CI82J.53.81.H04.1.454.heavy.3.raw
cgcgtatacacacgaccggtgctcgatttagtagtgtagattcgcggggagctctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaagggactggagtgggtggcagttatatcatttgatggaagcactacatactacgcaaactccgtgaagggccgattcaccatctccagagacgattccaggaacactctgtttctccaaatgaacagcctgagagctggaggacacggctctttattactgtgcgagagatttctggatacagcct

SEQ ID NO: 455927 - DNA, 482 bp, Homo sapiens; identical to SEQ ID NO: 444503
  misc_feature: HEFZJCU01CNM89.7.10.A10.1.454.heavy.3.raw

SEQ ID NO: 455928 - DNA, 519 bp, Homo sapiens
  misc_feature: HEFZJCU01BEY1E.53.29.C07.1.454.heavy.3.raw
cgcgtatacacacgaccggtgctcgatttagagtgctacgaagggaaaggggtcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcaccatctcgagagacaattccaggaacacgctgtatctgcaaatgaacggcctgagagctgaggacacggctgtgtattactgtgcgtaaacggtttgagtgggaagttaggggtctgagtacggtagtggacgtcgtggggccaaggggaccgacggtcaccgtcgtcctcc

SEQ ID NO: 455929 - DNA, 506 bp, Homo sapiens; identical to SEQ ID NO: 446520
  misc_feature: HEFZJCU01EGPJP.10.38.D05.1.454.heavy.3.raw

SEQ ID NO: 455930 - DNA, 498 bp, Homo sapiens
  misc_feature: HEFZJCU01BY4TY.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgaccctggggccagggaaccctggtcgtcgtctcgtctgcctccaccaagggcccatcggtcttcccctggcgccctgctccaggagcacctccgagagcacagcggccctgggctgcctggtcaggactacttcctagtacgtga

SEQ ID NO: 455931 - DNA, 524 bp, Homo sapiens; identical to SEQ ID NO: 445728
  misc_feature: HEFZJCU01BVJRH.5.33.C11.1.454.heavy.3.raw

SEQ ID NO: 455932 - DNA, 488 bp, Homo sapiens
  misc_feature: HEFZJCU01D204E.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttccccctggcgccctgctccaggagcacctccgagagcacagcggccctgggctgcctgtcaaggactactcctacgtgagct

SEQ ID NO: 455933 - DNA, 499 bp, Homo sapiens
  misc_feature: HEFZJCU01EIWL1.4.58.F03.1.454.heavy.3.raw
  modified_base (460)..(460): a, c, t, g, unknown or other
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatgggagctgagcagcctgacatctgaagacacggctgtgtattactgttcgagcgggntagtctgggatctagtttatagtgactcgtcgtctgggg

SEQ ID NO: 455934 - DNA, 476 bp, Homo sapiens; identical to SEQ ID NO: 445154
  misc_feature: HEFZJCU01B9N40.16.10.A10.1.454.heavy.3.raw

SEQ ID NO: 455935 - DNA, 526 bp, Homo sapiens
  misc_feature: HEFZJCU01DJSNQ.53.34.D01.1.454.heavy.3.raw
cgcgtatacacacgaccggtgctcgatttagatcgtctgtgttgggtttgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgaccccgtggggccagggaaccctggtcaccgtctcctcagcttccaccaagggcccatcggtcttcccctggccgccctgcctccaggacgcacctcgtgggggcacagcggccctggggctcggccttgggtcaaagggacctacttcctcggttactggccg

SEQ ID NO: 455936 - DNA, 521 bp, Homo sapiens
  misc_feature: HEFZJCU01D2QAK.12.71.G05.1.454.heavy.3.raw
  modified_base (466)..(466): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttcccctggcgccctgctccaggngcacctccgagagcacagcggccctgggctgcctggtcaaggactacttcctacg

SEQ ID NO: 455937 - DNA, 386 bp, Homo sapiens; identical to SEQ ID NO: 446054
  misc_feature: HEFZJCU01AHO7G.18.60.F05.1.454.heavy.3.raw

SEQ ID NO: 455938 - DNA, 519 bp, Homo sapiens
  misc_feature: HEFZJCU01CF530.51.60.F05.1.454.heavy.3.raw
cgatcgtatacacgaccggtgctcgatttagtacgtcatcagggaaagggtgtacacctgtggttctcggggctgccctttggctttggagatggttttctcgatgggggctgggggagacgagcccagcactcgaagtcgccggtgtttccattcggtgatcatcactgaacacagaggactcaccatggagtttgggctgagctgggttttcctcgttgctcttttaagaggtgtccagtgtcaggtgcggctggtggagtctggggaggcgtggtccagcctggggattccctgagaatctcctgtgcagcctctggattcaacttcaatagacatcctatgcactgggtccgccaggctccaggcaaggggctggaatgggtggcagttatttcgtccactggaaacagtaaacattatggacgctccgtgaagggcccattcgccatctccagagacaattccaaaaatccctctatctgcgaatgaacagcctgcgacctgaagacacggcta

SEQ ID NO: 455939 - DNA, 491 bp, Homo sapiens; identical to SEQ ID NO: 445531
  misc_feature: HEFZJCU01APU1D.11.38.D05.1.454.heavy.3.raw

SEQ ID NO: 455940 - DNA, 501 bp, Homo sapiens
  misc_feature: HEFZJCU01C1XJV.11.19.B08.1.454.heavy.3.raw
cgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccgccaggctccagggaaggggctggagtgggtttcatacatttctagtaattctggtaccatacactatgcagtctctgtgaagggccgattcaccatctccagagacaacgccaggaactcactttatctgcaaatgagcagcctgagagtcgaggacacgggtatttattactgtgcgagagatagtctgtctatgcttccgggagctaa

SEQ ID NO: 455941 - DNA, 503 bp, Homo sapiens
  misc_feature: HEFZJCU01DUBCX.9.33.C11.1.454.heavy.3.raw
tgatacgtctcacgaccggtgctcgatttagagtgagctcgttgggtttggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgccctgctccaggagcacctccgagagcacagcggccctgggctgcctggtcaaggactacttcagacgtatca

SEQ ID NO: 455942 - DNA, 501 bp, Homo sapiens
  misc_feature: HEFZJCU01EUMYN.10.71.G05.1.454.heavy.3.raw
catagtagtgcacgaccggtgctcgatttagtgtcgtcgcaagagagaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacggggtgtttattactgtgggagaaatcctagtggcatcacctggtattgg

SEQ ID NO: 455943 - DNA, 390 bp, Homo sapiens; identical to SEQ ID NO: 444541
  misc_feature: HEFZJCU01ALTKC.16.24.C02.1.454.heavy.3.raw

SEQ ID NO: 455944 - DNA, 495 bp, Homo sapiens
  misc_feature: HEFZJCU01BY2EM.40.81.H04.1.454.heavy.3.raw
tctagcgactcacgaccggtgctcgatttagtagtgtagattcgcgggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctacgcgggctgaccactgggccg

SEQ ID NO: 455945 - DNA, 517 bp, Homo sapiens
  misc_feature: HEFZJCU01DBPA1.3.17.B06.1.454.heavy.3.raw
  modified_base (441)..(441): a, c, t, g, unknown or other
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcacatctcaagagatgattcagagaactcactttatctgcaaatgaacngcctgagaaccgacgacacggccgtctattattgtgtcatagacctaggatacaacgacggtggtacctggtattc

SEQ ID NO: 455946 - DNA, 519 bp, Homo sapiens
  misc_feature: HEFZJCU01DFZUB.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtgggccggggaaccctggtcaccgtctcttcagcctccaccaagggcccatcggtcttcccctcggcaccctcctccaacgtacgcacctctcgggggcac

SEQ ID NO: 455947 - DNA, 482 bp, Homo sapiens
  misc_feature: HEFZJCU01ELMFL.52.8.A08.1.454.heavy.3.raw
cgcagtacgacacgaccggtgctcgatttagcatactctacagggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaaggccgattcatcatctccagagacaactccgaagaacacgctgtatctgcaaatgaacaggctgagagctagaagacacggctgtaatattactgtgacgaacttaa

SEQ ID NO: 455948 - DNA, 498 bp, Homo sapiens
  misc_feature: HEFZJCU01CTH50.51.87.H10.1.454.heavy.3.raw
cgatcgtatacacgaccggtgctcgatttagcagtactgcgttgggtttggggacccaaaaaccacacccctccttgggagaatcccctagatcacagctcctcaccatggactggacctggagcatccttttcttggtggcagcagcaacaggtgcccactcccaggttcagctggtacagtctggagctgaagtgaagaagcctggggcctcagtgaaggtctcctgcaaggcctctggttacacctttatgaattatggtatcagctgggtgcgccaggcccctggacaagggcttgagtggatgggatggatcagcgcttacactggtgacacaaagtatgcacagaaactccagggcagagtcaccatgaccacagacacgtccacgagcacagcctacatggaactgaggagcctgggatctgacgacacggccgtgtattactgtgcgagagatagccccaggggagagtagtggttttcacgctggcatt

SEQ ID NO: 455949 - DNA, 494 bp, Homo sapiens; identical to SEQ ID NO: 445100
  misc_feature: HEFZJCU01C71DJ.52.53.E09.1.454.heavy.3.raw

SEQ ID NO: 455950 - DNA, 518 bp, Homo sapiens; identical to SEQ ID NO: 451751
  misc_feature: HEFZJCU01B08WS.9.34.D01.1.454.heavy.3.raw

SEQ ID NO: 455951 - DNA, 516 bp, Homo sapiens
  misc_feature: HEFZJCU01B0NW7.10.53.E09.1.454.heavy.3.raw
catagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttcagcactgggccgac

SEQ ID NO: 455952 - DNA, 513 bp, Homo sapiens; identical to SEQ ID NO: 446699
  misc_feature: HEFZJCU01ASMY5.12.25.C03.1.454.heavy.3.raw

SEQ ID NO: 455953 - DNA, 510 bp, Homo sapiens; identical to SEQ ID NO: 448108
  misc_feature: HEFZJCU01DYUY3.11.13.B02.1.454.heavy.3.raw

SEQ ID NO: 455954 - DNA, 504 bp, Homo sapiens
  misc_feature: HEFZJCU01EW31V.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccagttcaccatctccagagacaattccaagaacacactgtatctgcaaatgaacagcctgagagccgacgacacggccatatattactgtgcgaaagcaccggcagttagtcacccatactactttgactactc

SEQ ID NO: 455955 - DNA, 503 bp, Homo sapiens
  misc_feature: HEFZJCU01EO1LZ.40.81.H04.1.454.heavy.3.raw
tctagcgactcacgaccggtgctcgatttagtagtgtagattcgcggggccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcgggactggacctacgtgacgactacggccatgtattactgtggaagagacgttggtggctaccggcggggctgaccg

SEQ ID NO: 455956 - DNA, 501 bp, Homo sapiens; identical to SEQ ID NO: 448591
  misc_feature: HEFZJCU01DA9YF.13.87.H10.1.454.heavy.3.raw

SEQ ID NO: 455957 - DNA, 493 bp, Homo sapiens
  misc_feature: HEFZJCU01CUGYP.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctctccaagagcacctctgggggcacagcggcctgggctgcctggtcaaggactattccgagtagtaca

SEQ ID NO: 455958 - DNA, 427 bp, Homo sapiens; identical to SEQ ID NO: 444708
  misc_feature: HEFZJCU01ERA5X.9.34.D01.1.454.heavy.3.raw

SEQ ID NO: 455959 - DNA, 488 bp, Homo sapiens
  misc_feature: HEFZJCU01D93KV.49.4.A04.1.454.heavy.3.raw
agtcgagagacacgaccggtgctcgatttagagtagtgatcagggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtgggtggcatttatctcatatgatggaagcaagatatactacattgactccgtgaagggccgattcatcatctccagagacaactccgagaacacactgtatcttcaaatgaacaggttgagagctgaagacacggctttatattactgtgacgaacttaatcacggac

SEQ ID NO: 455960 - DNA, 506 bp, Homo sapiens
  misc_feature: HEFZJCU01DZNLU.3.67.G01.1.454.heavy.3.raw
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgaagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtcccg

SEQ ID NO: 455961 - DNA, 502 bp, Homo sapiens
  misc_feature: HEFZJCU01CRFRD.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaacgggcccatcggtcttcccctggccgcctgctcc

SEQ ID NO: 455962 - DNA, 490 bp, Homo sapiens
  misc_feature: HEFZJCU01CGECH.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctcccgagagcacagcggccctgggctgcctggtcaaggactacttcccatactcgta

SEQ ID NO: 455963 - DNA, 523 bp, Homo sapiens
  misc_feature: HEFZJCU01C6CEY.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccactcggtccttccccctggccgccctgctccaggagcacctccgagagcacagcggccc

SEQ ID NO: 455964 - DNA, 519 bp, Homo sapiens; identical to SEQ ID NO: 445617
  misc_feature: HEFZJCU01BMJAB.9.34.D01.1.454.heavy.3.raw

SEQ ID NO: 455965 - DNA, 480 bp, Homo sapiens; identical to SEQ ID NO: 445011
  misc_feature: HEFZJCU01ACXQK.22.36.D03.1.454.heavy.3.raw

SEQ ID NO: 455966 - DNA, 500 bp, Homo sapiens
  misc_feature: HEFZJCU01AULNL.11.27.C05.1.454.heavy.3.raw
cgagagataccacgaccggtgctcgatttagacgcgatcgaagggtttgggggagaggaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaatgaacagcctgagagccgaggacacggctgtgtattactgtgcgagaggagctattatctggaaccccgat

SEQ ID NO: 455967 - DNA, 490 bp, Homo sapiens
  misc_feature: HEFZJCU01AUFUR.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagttttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatccta

SEQ ID NO: 455968 - DNA, 541 bp, Homo sapiens
  misc_feature: HEFZJCU01AWBUF.15.86.H09.1.454.heavy.3.raw
tctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaagtaaaatgatggtgagaaaatagactacggtgcacccgtgaaaggaagattcaccatctcaagagataattcaaaaacgacggtgtatttgcaaatgaacagcctgaaaaccgaggacacagccgtctattactgtaccacagattcggaagtgcatcgacgtaaaggaggctatgcttttgatatctggggcccagggac

SEQ ID NO: 455969 - DNA, 523 bp, Homo sapiens
  misc_feature: HEFZJCU01EUUTF.22.28.C06.1.454.heavy.3.raw
acatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtggctccatcagtgattactactggacctggatccggcagtccccagggcagggactggaatggattggatatttccatacgactgcgatgaccaactgcaacccctccctcagggctcgagtcagcctgtcagtagacacgtccaagaaccagacttccctgagactgacctctgtgaccgccgcagacacggccgtgtatttctgtgtcggtacgagtgtccatgacagtcacaaacaactggtctcctggggccagggaaccctggtcaccgtctcctcagcctccaccaagggcccatcggtcttccccctggcaccctcctccaagagcacctctgggggcacagcc

SEQ ID NO: 455970 - DNA, 505 bp, Homo sapiens
  misc_feature: HEFZJCU01C9Q7A.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctgggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaaggcccatcggtcttcccctgcgcctgctcagagcacctccgagagcacagcggcctcggg

SEQ ID NO: 455971 - DNA, 521 bp, Homo sapiens
  misc_feature: HEFZJCU01DZ3U8.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggccaccctccctccaagagcacctctgggggcacagcggccctgggctgcctggtcaaggactacttcctagagacacg

SEQ ID NO: 455972 - DNA, 497 bp, Homo sapiens
  misc_feature: HEFZJCU01DXWU4.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacgacgggttgtttattactggtgggagaaatcctaagtgg

SEQ ID NO: 455973 - DNA, 509 bp, Homo sapiens; identical to SEQ ID NO: 445824
  misc_feature: HEFZJCU01C2BGI.9.14.B03.1.454.heavy.3.raw

SEQ ID NO: 455974 - DNA, 522 bp, Homo sapiens
  misc_feature: HEFZJCU01BRLBT.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatcggtcttcccctggcg

SEQ ID NO: 455975 - DNA, 465 bp, Homo sapiens
  misc_feature: HEFZJCU01BMPAC.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggcccatcggtcttccccctggcgccctgctccaggagcacctccgagagcacagcgaccctgggctgcctggtcaaggactacttcccacgagagta

SEQ ID NO: 455976 - DNA, 509 bp, Homo sapiens
  misc_feature: HEFZJCU01EDYKP.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacgggcaggcggcctttggactttcgtc

SEQ ID NO: 455977 - DNA, 514 bp, Homo sapiens
  misc_feature: HEFZJCU01CORQC.3.23.C01.1.454.heavy.3.raw
agacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagcccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccaacgggcccactcggtcttccccctggccgtcccg

SEQ ID NO: 455978 - DNA, 483 bp, Homo sapiens
  misc_feature: HEFZJCU01DTXRM.51.67.G01.1.454.heavy.3.raw
cgatcgtatacacgaccggtgctcgatttagagtatacatattgggtttgggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgtaaa

SEQ ID NO: 455979 - DNA, 510 bp, Homo sapiens
  misc_feature: HEFZJCU01EZTX3.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgttttctaggtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggttccgcggtccgggt

SEQ ID NO: 455980 - DNA, 497 bp, Homo sapiens
  misc_feature: HEFZJCU01CAFEZ.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctgggccgtggcaccctgctgactgtctcctcagcctccaccaagggcccatcggtcttcccctggcgccctgctccaggagcacctccgagagcacagcggccctgggctgcctggtcaaggactaccg

SEQ ID NO: 455981 - DNA, 523 bp, Homo sapiens; identical to SEQ ID NO: 446270
  misc_feature: HEFZJCU01DZXRN.12.40.D07.1.454.heavy.3.raw

SEQ ID NO: 455982 - DNA, 537 bp, Homo sapiens
  misc_feature: HEFZJCU01D7BY4.48.43.D10.1.454.heavy.3.raw
agtatacatacacgaccggtgctcgatttagactagcagtaaggggacatgggaagtgctttctgagagtcatggacctcctgcacaagaacatgaaacacctgtggttcttcctcctcctggtggcagctcccagatgggtcctgtcccaggtacagctacaacagtggggcgcaggacatttgaagccttcggagacgctgtccctcacctgcgctgtgtatggtgggtccttcaggggttacttctggacctggatccgccagcccccagggaaggggctggagtggattggggaggtcaggcatagtgccagggccacttacaacccgtccctcaacgatcgagtctccatcttagtttgacacgtccaagaacccagttctcccttcaacttcacgtctgtgaccgccgcggacacggctatatactactgtgcgagagggtccctggctctctccgcctttgacgcctggggccagggaaactggtcaccgtctcctcagcttccaccaagggcccatcggtcttcccctc

SEQ ID NO: 455983 - DNA, 508 bp, Homo sapiens; identical to SEQ ID NO: 445594
  misc_feature: HEFZJCU01BF6FS.17.25.C03.1.454.heavy.3.raw

SEQ ID NO: 455984 - DNA, 531 bp, Homo sapiens
  misc_feature: HEFZJCU01A6RTL.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaaggcccatcggtcttcccctggcaccctcctccaagagcacctctggggcac

SEQ ID NO: 455985 - DNA, 400 bp, Homo sapiens; identical to SEQ ID NO: 444452
  misc_feature: HEFZJCU01A05FD.47.24.C02.1.454.heavy.3.raw

SEQ ID NO: 455986 - DNA, 518 bp, Homo sapiens; identical to SEQ ID NO: 444718
  misc_feature: HEFZJCU01DJBOB.9.34.D01.1.454.heavy.3.raw

SEQ ID NO: 455987 - DNA, 487 bp, Homo sapiens
  misc_feature: HEFZJCU01ELVY3.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaaggcccatcggtcttcccctggcgccctgctccaggagcacctccgagagcacagcggccctgggctgcctggtcaggactacttcccatactcgta

SEQ ID NO: 455988 - DNA, 508 bp, Homo sapiens
  misc_feature: HEFZJCU01ECQJP.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaggcagattcatcatctcaagagatgattccaacggcatcgcctatctgcagatgaacagcctgaagacgaggacacagccgtctattactgtgttagggtagtttacgtatttttggt

SEQ ID NO: 455989 - DNA, 513 bp, Homo sapiens
  misc_feature: HEFZJCU01BSRT2.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggactctggtcaccgtctcctcagcctccaccaagggcccatcggtcttccccctggcgccctcgctccaggagcacctccgagagcacagcggccctcggg

SEQ ID NO: 455990 - DNA, 501 bp, Homo sapiens; identical to SEQ ID NO: 455940
  misc_feature: HEFZJCU01B885J.11.19.B08.1.454.heavy.3.raw

SEQ ID NO: 455991 - DNA, 481 bp, Homo sapiens; identical to SEQ ID NO: 445006
  misc_feature: HEFZJCU01DX6VF.7.10.A10.1.454.heavy.3.raw

SEQ ID NO: 455992 - DNA, 512 bp, Homo sapiens
  misc_feature: HEFZJCU01DZYT8.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgacgagcacagcggccctgggctgcctggtcaaggactactt

SEQ ID NO: 455993 - DNA, 392 bp, Homo sapiens; identical to SEQ ID NO: 444682
  misc_feature: HEFZJCU01C349C.16.70.G04.1.454.heavy.3.raw

SEQ ID NO: 455994 - DNA, 503 bp, Homo sapiens
  misc_feature: HEFZJCU01ERKOA.14.55.E11.1.454.heavy.3.raw
cgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatgggagggggtggtgatccgta

SEQ ID NO: 455995 - DNA, 510 bp, Homo sapiens; identical to SEQ ID NO: 451656
  misc_feature: HEFZJCU01ERNZO.48.81.H04.1.454.heavy.3.raw

SEQ ID NO: 455996 - DNA, 477 bp, Homo sapiens; identical to SEQ ID NO: 444659
  misc_feature: HEFZJCU01E179U.16.10.A10.1.454.heavy.3.raw

SEQ ID NO: 455997 - DNA, 524 bp, Homo sapiens
  misc_feature: HEFZJCU01DIW7H.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccaagagcacctctgggggcacgagcc

SEQ ID NO: 455998 - DNA, 507 bp, Homo sapiens
  misc_feature: HEFZJCU01A7L4N.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctggggc

SEQ ID NO: 455999 - DNA, 479 bp, Homo sapiens; identical to SEQ ID NO: 447128
  misc_feature: HEFZJCU01DJOMH.4.37.D04.1.454.heavy.3.raw

SEQ ID NO: 456000 - DNA, 504 bp, Homo sapiens
  misc_feature: HEFZJCU01BD5WV.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctggctgcctggtcaggactacttcccactacta

SEQ ID NO: 456001 - DNA, 527 bp, Homo sapiens; identical to SEQ ID NO: 446775
  misc_feature: HEFZJCU01DYR0Q.9.78.H01.1.454.heavy.3.raw

SEQ ID NO: 456002 - DNA, 491 bp, Homo sapiens
  misc_feature: HEFZJCU01CSWAF.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtatactgtgcgaaagatttctat

SEQ ID NO: 456003 - DNA, 524 bp, Homo sapiens
  misc_feature: HEFZJCU01ES46T.51.45.E01.1.454.heavy.3.raw
cgatcgtatacacgaccggtgctcgatttagtgagtcagtaagggaaagggggcatcacataacaaccagattcctcctctaaagaagcccctgggagcacagttcatcaccatggactggacctggaagttcctctttgtggtggcagcagcaacaggtgtccagtcgcaggtccagctggtgcagtctgggactgaggtgaagaggcctgggtcctcggtgaaggtctcctgcaaggcatctaaaaacatcttaagaagttatgacatcgcctgggtgcgacaggcccctggacatgggcttgagtgggtgggcaggatcatccctatgtttggagtcgcaaactacgcacagaagttccggggcaaagtcacgttgaccgcggacacagtcacggacacagcctacatggaactcaacggcctcagatttgaggacacggccgtctattattgtgcgagagtgagaaattacggtggcgtactcccttgactactggggccaggggaaccctggtctaccg

SEQ ID NO: 456004 - DNA, 504 bp, Homo sapiens
  misc_feature: HEFZJCU01AIDKA.11.71.G05.1.454.heavy.3.raw
  modified_base (483)..(483): a, c, t, g, unknown or other
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtggggtggcagttatttcatatgatggaaatagtgacttctattcagactccgtgaagggccgattcaccgtctccagagacaattccaggccacacgctgtatctgcaaatgaacagcctgagagctgaggacacgggctggtgtattactgtgcgaaagnttttctatagaggtgacgtac

SEQ ID NO: 456005 - DNA, 483 bp, Homo sapiens; identical to SEQ ID NO: 444924
  misc_feature: HEFZJCU01AYS92.10.35.D02.1.454.heavy.3.raw

SEQ ID NO: 456006 - DNA, 512 bp, Homo sapiens; identical to SEQ ID NO: 445688
  misc_feature: HEFZJCU01DDWMN.3.34.D01.1.454.heavy.3.raw

SEQ ID NO: 456007 - DNA, 513 bp, Homo sapiens
  misc_feature: HEFZJCU01CL58T.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaagggcccatcggtcttccccctggcaccctcctccaagagcacctctgggggcacagcggccctgggctgcctggtcaaggactacttccgtactacg

SEQ ID NO: 456008 - DNA, 508 bp, Homo sapiens
  misc_feature: HEFZJCU01EWE8I.49.38.D05.1.454.heavy.3.raw
agtcgagagacacgaccggtgctcgatttagtatctgatagttgggtttggggagctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttga

SEQ ID NO: 456009 - DNA, 518 bp, Homo sapiens; identical to SEQ ID NO: 448852
  misc_feature: HEFZJCU01B8Z81.16.10.A10.1.454.heavy.3.raw

SEQ ID NO: 456010 - DNA, 547 bp, Homo sapiens
  misc_feature: HEFZJCU01ENAHG.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagcgtggagtttccttagctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaactgatggtgggacaacagactacgctgcacccgtgaaaggcagattcaccatctcaagagatgattcaaaagcacgctgtatctgcaaatgaacagcctgagaaccgaggacacagccgtgtattactgtactagacaggtggattacattttgggggagtttatcgacgaaacgggggggtacgtaacgttacgcgt

SEQ ID NO: 456011 - DNA, 493 bp, Homo sapiens
  misc_feature: HEFZJCU01AYFF9.51.60.F05.1.454.heavy.3.raw
cgatcgtatacacgaccggtgctcgatttagtacgtcatcagggaaaggggctgggagaggagcccagcactagaagtcggcggtgtttccattcggtgatcagcactgaacacagaggactcaccatggagtttgggctgacctgggttttcctcgttgctcttttaagaggtgattcatggagaagtagagagactgagtgtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttattcatatgatggaagtaaatattctatgtagactccgtgaagggccgcttcatcatctccagagacaattcccagaacaccctgtttctgcaaatgcacagcctgagacctgaggacacggctgtgtta

SEQ ID NO: 456012 - DNA, 533 bp, Homo sapiens
  misc_feature: HEFZJCU01A31SH.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtatggctgtgtttattggggccagggagccctggtcaccg

SEQ ID NO: 456013 - DNA, 500 bp, Homo sapiens
  misc_feature: HEFZJCU01EX5WU.47.56.F01.1.454.heavy.3.raw
agctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgctattttaaaaggtgtccagtgtgaggtgcaactggtggagtccgggggaggcttaattcagcctggggggtccctgagactctcctgtgcagcctctggattcaccttcagtagttactggatgcactgggtccgccaagctccagggaagggactggtgtgggtctcacgtattaatcctgatggaagtcgcacaaactacgcggactccgtgagggaccgattcaccatctccagagacaacgccaagaacacgctgtatctgacaaatgcacagtctgagagccgacgatgcggctgtatatttctgtgcaagagatcaactggtgggaccgtatttatttc

SEQ ID NO: 456014 - DNA, 523 bp, Homo sapiens
  misc_feature: HEFZJCU01DCRA7.47.78.H01.1.454.heavy.3.raw
agctcacgtacacgaccggtgctcgatttagtgtgagtagtttgggtttggggctctctgagagtcagggacctcctgcattagcacatgaaacacctgtggttcttccgcctcctggtgacagctcccagatttgactgcctcaggaatgccgatttgaagatgtgagatgctgcctctgatcccaggactcactgcgggtttctctgttcacaggggtcctgtcccaggtgcaaccacaccactggggcgcaggactgttgaagccttcggagaccctgtccctcacctgcgctgtctgtggtgggtccttcagtgactactactgagactagatccgccagtccccagggaaggggctggaatggattcgacaggtcaatcattacagatccaccaactacaacccgtccctcacgcagtcgagtcaccttttcgcttgacacgtccaacaccagttttctctgaatcaaaacccgagaccgccgcggacagcctcggcccctggggcccagtaaacccg

SEQ ID NO: 456015 - DNA, 491 bp, Homo sapiens; identical to SEQ ID NO: 445531
  misc_feature: HEFZJCU01BDF73.11.38.D05.1.454.heavy.3.raw

SEQ ID NO: 456016 - DNA, 507 bp, Homo sapiens; identical to SEQ ID NO: 455428
  misc_feature: HEFZJCU01CCX5V.13.37.D04.1.454.heavy.3.raw

SEQ ID NO: 456017 - DNA, 518 bp, Homo sapiens; identical to SEQ ID NO: 444718
  misc_feature: HEFZJCU01B561Y.9.34.D01.1.454.heavy.3.raw

SEQ ID NO: 456018 - DNA, 505 bp, Homo sapiens
  misc_feature: HEFZJCU01BZLA3.49.80.H03.1.454.heavy.3.raw
agtcgagagacacgaccggtgctcgatttagctgtgcgtcgaaggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggccaccctcctccaagagcacctcgtgggggcacgagcggccctgggctgcctggtcaggactacttcctctc

SEQ ID NO: 456019 - DNA, 491 bp, Homo sapiens
  misc_feature: HEFZJCU01DA5QI.49.17.B06.1.454.heavy.3.raw
  modified_base (478)..(478): a, c, t, g, unknown or other
agtcgagagacacgaccggtgctcgatttagtcgatagtgaaggggtctgggagacgagcccagcactggaagtcgccggtgtttccattcggtgatcatcactgaacacagaggactcaccatggagtttgggctgagctgggttttcctcgttgctcttttcagaggtgtccagtgttatgtgcagctggtggagtctgggggaggcgtggtccagcctgggaggtccctgagactcgcctgcaaaccgtccggattcaccttcagtaattatgcaatgcactgggtccgccagactccaggcaaggggctgcactgggtggcggccatatcatttgatggaagcaagaaatactatgcagactccgtgaggggccgattcaccatctccagagacagttccgatgacacagtgtatctgcaaatgaacagcctgagacctgaggacacggctctcttttactgtgcgccaggaancagtggctggccg

SEQ ID NO: 456020 - DNA, 510 bp, Homo sapiens
  misc_feature: HEFZJCU01COZBX.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaaggcccatcggcttccccctggcaccctcctccaagagcacctctgggggcacagcggcctgggctgcctggtcaaggactacttccgagtgcgtct

SEQ ID NO: 456021 - DNA, 530 bp, Homo sapiens
  misc_feature: HEFZJCU01D3073.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaaggcctggagtggattggatacatctattactttgggagcacctactacaacccgtcctcaagagtcgagtaacgatctcagtggacacgtctaacaatcacctctcctgagctgagctctgtgacagccgcggacacgggcgtttattactgtgcgaggaggggacggacgtacggtgactacgtgggggttccgaccccgtggggccagggaaccctggtccaccgtctcctcacgcctccaccg

SEQ ID NO: 456022 - DNA, 512 bp, Homo sapiens; identical to SEQ ID NO: 450914
  misc_feature: HEFZJCU01DUQ9O.15.67.G01.1.454.heavy.3.raw

SEQ ID NO: 456023 - DNA, 392 bp, Homo sapiens; identical to SEQ ID NO: 444682
  misc_feature: HEFZJCU01BR8M7.16.70.G04.1.454.heavy.3.raw

SEQ ID NO: 456024 - DNA, 512 bp, Homo sapiens
  misc_feature: HEFZJCU01BVBGA.48.12.B01.1.454.heavy.3.raw
agtatacatacacgaccggtgctcgatttagtagtgtagattccgcgggcacgaccggtgctcgatttagatcgtctgtgttgggggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgccg

SEQ ID NO: 456025 - DNA, 469 bp, Homo sapiens
  misc_feature: HEFZJCU01B5RSQ.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagtctccaccaagggcccatcggtcttcccctggcgccctgctcaggagcacctccgagagcacagcggccctgggctgcctggtcaaggactacttccctacagtgct

SEQ ID NO: 456026 - DNA, 506 bp, Homo sapiens
  misc_feature: HEFZJCU01EUGV7.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgaaccatctgttgagagtcgactgacaatacaacgtagacacatacgaagaaccaagttcttccctcgcagctcgacctctgtgacctcccgacggacgacgggtgttagtattacttgttggaaggacggacccccgacgtagtaacg

SEQ ID NO: 456027 - DNA, 423 bp, Homo sapiens; identical to SEQ ID NO: 446550
  misc_feature: HEFZJCU01BXNYW.11.22.B11.1.454.heavy.3.raw

SEQ ID NO: 456028 - DNA, 524 bp, Homo sapiens
  misc_feature: HEFZJCU01APKJF.2.37.D04.1.454.heavy.3.raw
acgctcgacacacgaccggtgctcgatttagtagcatactgttgggtttggggaagtagtccttgaccaggcagcccaggactggtgaagccttcggagaccctgtccctcacctgcactgtctctggtggctccattagtagttactactggacctggatccggcagaccccagggaagggactggagtggattgggtatgtctataacagtgggagcaccaactacaatccctccctgaagagtcgggtcaccatatcagttgacacgtccaagaaccagttctccctgaaactgaggtctgtgaccgatgcggacacggccgtatattattgtgcgagagtccctcttcagggcggctattactccggtctggacgtctggggccaaggggaccacggtcaccgtctcctcagcctccaccaagggcccatcggtcttcccctggcgccctgctccaggagcacctccgagagcacagcggccctgggctgcctggtcaaggactacttcctgtcgagcgt

SEQ ID NO: 456029 - DNA, 504 bp, Homo sapiens
  misc_feature: HEFZJCU01DT32J.3.71.G05.1.454.heavy.3.raw
agacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgtgtaagtcccgggaaatatagtacgta

SEQ ID NO: 456030 - DNA, 481 bp, Homo sapiens
  misc_feature: HEFZJCU01C9ZEY.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctcaccaagggcccatcggtcttccccctggcgccctgctccaggagcacctccgagagcacagcggccctggggctgcctggtcaaggactacttccacgcgtatgt

SEQ ID NO: 456031 - DNA, 528 bp, Homo sapiens
  misc_feature: HEFZJCU01DG1GF.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggccaggggaccctggtcatcgtctccccagccctccaccaagggcccatcggtcttccccctggcgccctcg

SEQ ID NO: 456032 - DNA, 518 bp, Homo sapiens
  misc_feature: HEFZJCU01C1HOG.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggctacttccagacgtatca

SEQ ID NO: 456033 - DNA, 482 bp, Homo sapiens; identical to SEQ ID NO: 445068
  misc_feature: HEFZJCU01BC7A2.11.23.C01.1.454.heavy.3.raw

SEQ ID NO: 456034 - DNA, 444 bp, Homo sapiens
  misc_feature: HEFZJCU01C26WX.3.86.H09.1.454.heavy.3.raw
agacgcactccacgaccggtgctcgatttagtgctatagacttgggtttgggattcacgttgcagatgtaggtctgggtgcgacaggctcctggaaaagggcttgagtggatgggaggttttgatcctgaagagcgtgaaagaatctacgcacagaatttccagggcagagtcaacatgaccgaggacacatccacagacacatcctacatggagttgaccagcctgagatctgaagacacggccgtgtattattgtgcaacagtcgcggctagcgcagcgggccctgatgcttttgatatctggggcccagggacattggtcaccgtctcttcagcctccaccaagggcccatcggtcttcccctggcaccctcctccaagagcacctctgggggcacagcggccctgggctgcctggtcaaggactacttccgagtgcgtct

SEQ ID NO: 456035 - DNA, 518 bp, Homo sapiens; identical to SEQ ID NO: 445423
  misc_feature: HEFZJCU01B73VQ.7.78.H01.1.454.heavy.3.raw

SEQ ID NO: 456036 - DNA, 515 bp, Homo sapiens
  misc_feature: HEFZJCU01BRYK0.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtctggggcctagggactacggtcaccgtctcctcagcctccaccaagggcccatcggtcttcccctcggcta

SEQ ID NO: 456037 - DNA, 522 bp, Homo sapiens
  misc_feature: HEFZJCU01BH8CB.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaaggcccatcggtcttcccctcggcaccctcctccaagagcacctctgggggcgacagcggccctcgggctgcctggtcaaggactacttccagtttagacacg

SEQ ID NO: 456038 - DNA, 517 bp, Homo sapiens; identical to SEQ ID NO: 446608
  misc_feature: HEFZJCU01BZBXK.9.34.D01.1.454.heavy.3.raw

SEQ ID NO: 456039 - DNA, 490 bp, Homo sapiens
  misc_feature: HEFZJCU01ENZJD.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgaggggccgattcaccatcttcagagacaacgccaaggacacgctgtatctggaaatgagcagtctgagagccgaggacacggctgtgtattactgtgcaagagataacggacttggtacgccctttgactactggggcccgggaccctggtcaccgtctcctcggcctccaccaagggcccatcggtcttcccctggcgccctgctccaggagcacctccgagagcacagcggccctgggctgcctggtcaaggactactccctacagtgct

SEQ ID NO: 456040 - DNA, 387 bp, Homo sapiens; identical to SEQ ID NO: 444818
  misc_feature: HEFZJCU01CET23.11.79.H02.1.454.heavy.3.raw

SEQ ID NO: 456041 - DNA, 520 bp, Homo sapiens
  misc_feature: HEFZJCU01D4ATF.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctggggccaggggaccctggtcatcgtctccccagcctccaccaagggcccatcggtcttcccctggcg

SEQ ID NO: 456042 - DNA, 490 bp, Homo sapiens; identical to SEQ ID NO: 445139
  misc_feature: HEFZJCU01CG7UP.12.75.G09.1.454.heavy.3.raw

SEQ ID NO: 456043 - DNA, 502 bp, Homo sapiens; identical to SEQ ID NO: 450016
  misc_feature: HEFZJCU01CRLAN.17.10.A10.1.454.heavy.3.raw

SEQ ID NO: 456044 - DNA, 503 bp, Homo sapiens; identical to SEQ ID NO: 445995
  misc_feature: HEFZJCU01DPQE8.17.25.C03.1.454.heavy.3.raw

SEQ ID NO: 456045 - DNA, 486 bp, Homo sapiens
  misc_feature: HEFZJCU01BTGMC.49.33.C11.1.454.heavy.3.raw
agtcgagagacacgaccggtgctcgatttagagtgagctcgttgggtttgggggggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctagaagacacggctgtatattactgtgcgaacttaatcac

SEQ ID NO: 456046 - DNA, 523 bp, Homo sapiens
  misc_feature: HEFZJCU01AN9RA.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaaccgttactacgctatggacgtcgtggggccaagggacccg

SEQ ID NO: 456047 - DNA, 437 bp, Homo sapiens; identical to SEQ ID NO: 444603
  misc_feature: HEFZJCU01BYPY6.3.21.B10.1.454.heavy.3.raw

SEQ ID NO: 456048 - DNA, 503 bp, Homo sapiens; identical to SEQ ID NO: 444557
  misc_feature: HEFZJCU01AIRKU.9.33.C11.1.454.heavy.3.raw

SEQ ID NO: 456049 - DNA, 492 bp, Homo sapiens
  misc_feature: HEFZJCU01DTY85.4.28.C06.1.454.heavy.3.raw
agcactgtagcacgaccggtgctcgatttagagctcacgtattgggtttgggaggcctagttcagcctgggacgtccctaagactctcctgtgcagcctctggattcaccttcagtagttactggctacattgggtccgccaggctccagggaaggggctggtctgggtctctcgtattgatagtgatggcagtaccagaggatatgcggacgccgtgagggccgattcaccatcttcagagacaacgccaaggacacgctgtatctggaaatgagcagtctgagagccgaggacacggctgtgtattactgtgcaagagataacggacttggtacgccctttgactactggggcccggggaccctggtcaccgtctcctcggcctccaccaagggcccatcggtcttcccctggcgccctgctccaggagcacctccgagagcacagcggccctcgggctgcctggtcaaggactacttccctacagtgct

SEQ ID NO: 456050 - DNA, 396 bp, Homo sapiens; identical to SEQ ID NO: 444433
  misc_feature: HEFZJCU01AUXNY.47.59.F04.1.454.heavy.3.raw

SEQ ID NO: 456051 - DNA, 489 bp, Homo sapiens
  misc_feature: HEFZJCU01DAQOP.51.14.B03.1.454.heavy.3.raw
cgatcgtatacacgaccggtgctcgatttagtgtgagtagtttgggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaaagccaaggcaacagctggtactcaattagactactggggccagggaaccctggtcaccgtctcctcagcctccaccaagggcccatcggtcttccccctggccaccctcctccaagagcacctctgggggcacagcggccctgggctgcctggtcaaggactacttcctcgtagcact

SEQ ID NO: 456052 - DNA, 511 bp, Homo sapiens
  misc_feature: HEFZJCU01DYZ5F.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttccccctggcgccctgctccaggagcacctctgggggcacagcggccctgggctgcctggtcaaggactacttccata

SEQ ID NO: 456053 - DNA, 521 bp, Homo sapiens; identical to SEQ ID NO: 445317
  misc_feature: HEFZJCU01EI8O3.12.40.D07.1.454.heavy.3.raw

SEQ ID NO: 456054 - DNA, 374 bp, Homo sapiens
  misc_feature: HEFZJCU01CUW9U.5.23.C01.1.454.heavy.3.raw
atcagacacgcacgaccggtgctcgatttagtacacgtgattagggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcgagagggacaggactacgtatatcgacgtctggggcagagggaccacggtcatcgtctcctcagcctccaccaagggcccatcggtcttccccctggcaccctcctccaagagcacctctgggggcacagcggccctgggctgcctggtcaaggactacttcccgtgtctgat

SEQ ID NO: 456055 - DNA, 526 bp, Homo sapiens
  misc_feature: HEFZJCU01D1BZQ.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgaccccgtggggccagggaaccctggtcaccgtctcctcagcctcaccg

SEQ ID NO: 456056 - DNA, 517 bp, Homo sapiens
  misc_feature: HEFZJCU01B26UG.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactgggccaggggaactctggtcaccgtctccgcagcctccaccaagggcccatcc

SEQ ID NO: 456057 - DNA, 525 bp, Homo sapiens
  misc_feature: HEFZJCU01CXA8Y.4.28.C06.1.454.heavy.3.raw
agcactgtagcacgaccggtgctcgatttagagctcacgtattgggtttgggggctttctgagagtcatgggcctcctgtgcaggaacatgaagcacctgtggttcttcctcctgctggtggcggctcccagatgggtcctgtcccaggtgcacttacaggagtcgggccctggactgctgaaggcttcggagactttgtccctcacctgcacagtatctggtgtgtccatcaggaatcctgattcctattggacttggatccgccaggccccagggaagggactgcagtgggttggtactgccttttatagtgggtcgacctactacagtccttccctcaaggggcgagtctccatgtcagtagattcgtccaggagtcagttctccctgacgttgaggtctgtgaccgtcgccgacacggccctctattattgtgcgagagagagctgttatggtcgcccattcgaaaactactgttacggtgtgggcgtgtggggccgagggaccacggtcatcgtctcccc

SEQ ID NO: 456058 - DNA, 519 bp, Homo sapiens
  misc_feature: HEFZJCU01C818Q.10.9.A09.1.454.heavy.3.raw
catagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccagcgggagttccaagtactcctttgacgtctggggccg

SEQ ID NO: 456059 - DNA, 501 bp, Homo sapiens
  misc_feature: HEFZJCU01DKVWF.14.25.C03.1.454.heavy.3.raw
cgtctagtaccacgaccggtgctcgatttagtagtgtagatttgggtttgggtgcccaagctgctggagggcacggtcaccacgctgctgagggagtagagtcctgaggactgtaggacagcctgggaggtccctgagactctcctgtgcagcctctggattcaccttcagtacctatgctatgcactgggtccgccaggctccaggcgaggggctggaagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctgggggccagggaaccctggtcaccgtctcctcagcctccaccaagggcccatcggtcttcccctggcaccct

SEQ ID NO: 456060 - DNA, 395 bp, Homo sapiens; identical to SEQ ID NO: 453087
  misc_feature: HEFZJCU01AX28N.47.46.E02.1.454.heavy.3.raw

SEQ ID NO: 456061 - DNA, 422 bp, Homo sapiens; identical to SEQ ID NO: 444681
  misc_feature: HEFZJCU01ARLQ7.16.78.H01.1.454.heavy.3.raw

SEQ ID NO: 456062 - DNA, 498 bp, Homo sapiens; identical to SEQ ID NO: 448023
  misc_feature: HEFZJCU01DF0H4.11.71.G05.1.454.heavy.3.raw

SEQ ID NO: 456063 - DNA, 558 bp, Homo sapiens
  misc_feature: HEFZJCU01DXZYU.18.14.B03.1.454.heavy.3.raw
tacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtggattacatttgggggtagttatcgcgaaacgggggggtactacgtacgctatggacgtcgtggggccgaagggaccacggtcaccgtctcctcagcctccaccaacggcccatccggtccttccccctggccgccctcgctccaggagcacctccgagacg

SEQ ID NO: 456064 - DNA, 390 bp, Homo sapiens
  misc_feature: HEFZJCU01BAK6H.7.60.F05.1.454.heavy.3.raw
cgtgtctctacacgaccggtgctcgatttagtacgtcatcagggaaaggggctggagtgggtctcagtgatttatagtagttccagttcatttcacgcagactccgtgaagggccgattcaccatctccagagacatttccaagaacacggtggatcttcagatggacagcctcagagcggaggacacggctgtctattactgtgtgagaggcgccaccgtggggatggaaacgattttcttgtttgtctggggccagggaaccctggtcaccgtctcctcagcctccaccaagggcccatcggtcttcccctggcgccctgctccaggagcacctccgagagcacagcggccctgggctgcctggtcaaggactattcctagagacacg

SEQ ID NO: 456065 - DNA, 497 bp, Homo sapiens; identical to SEQ ID NO: 446430
  misc_feature: HEFZJCU01CVGFW.51.78.H01.1.454.heavy.3.raw

SEQ ID NO: 456066 - DNA, 499 bp, Homo sapiens; identical to SEQ ID NO: 446493
  misc_feature: HEFZJCU01AZ3VO.12.38.D05.1.454.heavy.3.raw

SEQ ID NO: 456067 - DNA, 522 bp, Homo sapiens
  misc_feature: HEFZJCU01CLVWO.10.9.A09.1.454.heavy.3.raw
catagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagtttgtttcatctgagggcagtgttcaatggtatgctgacgccgtgaagggccgatttaccatctccagagacaactccaggaacacaatgtatttggacctgaacagcctaagtcctgaggacacgggtgtatactactgtacgaagggagggggaaccgagcgggagttccaagtactctttgacgtctgggcctac

SEQ ID NO: 456068 - DNA, 519 bp, Homo sapiens; identical to SEQ ID NO: 445330
  misc_feature: HEFZJCU01EW62E.7.78.H01.1.454.heavy.3.raw

SEQ ID NO: 456069 - DNA, 502 bp, Homo sapiens
  misc_feature: HEFZJCU01DHEPR.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtggaaatgaacagtctgagagccgaggacacggctctctattactgtgcgagagcccgaaatagggtctacg

SEQ ID NO: 456070 - DNA, 500 bp, Homo sapiens; identical to SEQ ID NO: 446033
  misc_feature: HEFZJCU01DVPNM.11.27.C05.1.454.heavy.3.raw

SEQ ID NO: 456071 - DNA, 517 bp, Homo sapiens
  misc_feature: HEFZJCU01DGLJD.47.78.H01.1.454.heavy.3.raw
agctcacgtacacgaccggtgctcgatttagtgtgagtagtttgggtttggggctctctgagagtcagggacctcctgcattagcacatgaaacacctgtggttcttccgcctcctggtgacagctcccagatttgactgcctcaggaatgccgatttgaagatgtgagatgctgcctctgatcccaggactcactgcgggtttctctgttcacaggggtcctgtcccaggtgcaaccacaccactggggcgcaggactgttgaagccttcggagaccctgtccctcacctgcgctgtctgtggtgggtccttcagtgactactactgagactagatccgccagtccccagggaagggctggaatggattcgacaggtcaatcattacagatccaccaactacaacccgtccctcagcagtcgagtcacctttcgcttgacacgtccaacaaccagttttctctgatcaaacccgagaccgccgcgacagcctcggcccctggggcccagaaacccg

SEQ ID NO: 456072 - DNA, 515 bp, Homo sapiens
  misc_feature: HEFZJCU01APQVB.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggatccctggctggcacctgtatccgaccgttggagtcagggaactctggtcaccgtctcctcagcctccaccagggcccatcggtccttcccctggcgccctgctccgaggagcacctccgagagcacagcggccctgggctcg

SEQ ID NO: 456073 - DNA, 498 bp, Homo sapiens
  misc_feature: HEFZJCU01C4UFM.19.26.C04.1.454.heavy.3.raw
  modified_base (359)..(359): a, c, t, g, unknown or other
tactctcgtgcacgaccggtgctcgatttagtctagcgactttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatntattatggagactccgtgaagggccgattcaccatctccagagacaattccaagaacacagtggatctgcaaatgaacagcctgagagctgggggacacgggctgtgtattactgtgcgagagcggctggcaactacat

SEQ ID NO: 456074 - DNA, 535 bp, Homo sapiens
  misc_feature: HEFZJCU01EABIR.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaatgaacagcctgagaaccgaggacacagccgtgtattactgtaccacatcccctgaaagcgtcaactactactactacggtatggacctctgggaccg

SEQ ID NO: 456075 - DNA, 511 bp, Homo sapiens
  misc_feature: HEFZJCU01BGCLE.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctcaccaaggccc

SEQ ID NO: 456076 - DNA, 517 bp, Homo sapiens; identical to SEQ ID NO: 449721
  misc_feature: HEFZJCU01CGQPH.52.52.E08.1.454.heavy.3.raw

SEQ ID NO: 456077 - DNA, 486 bp, Homo sapiens
  misc_feature: HEFZJCU01C0F4S.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaatgagcagcctggaaagcgatgacacaggactctattattgtaccactaagagtcccacgaagactgtgggaagggactgctggggccagggagcccttgtcaccgtctcctcagcctccaccaagggcccatcggtcttccccctcggcgccctcgctccaggagcacctccgagagcacagcggcccgtgggctgcctggtcaaggactacttcccactactatg

SEQ ID NO: 456078 - DNA, 496 bp, Homo sapiens; identical to SEQ ID NO: 444697
  misc_feature: HEFZJCU01EILUT.16.37.D04.1.454.heavy.3.raw

SEQ ID NO: 456079 - DNA, 484 bp, Homo sapiens
  misc_feature: HEFZJCU01C063Y.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaaggcccatcggtcttcccctggcgcctgctcaggagcacctccgagagcacagcggccctgggctgcctgatcaaggactacttcctacgtgagct

SEQ ID NO: 456080 - DNA, 450 bp, Homo sapiens
  misc_feature: HEFZJCU01D5AYT.53.57.F02.1.454.heavy.3.raw
cgcgtatacacacgaccggtgctcgatttagctcgatatagttgggtttgggctcggggctgccctttggctttggagatggttttctcgatgggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgaacttaattacggaggacaacggtaaccccgtccgcacggtacggacgtctggggccaagggaccacggtcaccgtctcctcagcctccaccaagggcccatcggtcttccccctggcaccctcctcccaagagcacctctgggggcacagcggccctgggctgcctggtcaaggactacttcctcgtactgcg

SEQ ID NO: 456081 - DNA, 518 bp, Homo sapiens
  misc_feature: HEFZJCU01DPKTG.2.21.B10.1.454.heavy.3.raw
acgctcgacacacgaccggtgctcgatttagtgtcgtcgcaagagagagaggtgccttagccctgaattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattactagtagtggtagtaccatatattacgcagactctgtgaagggccgattcaccatctccagagacaacgcccagaactcactgtatctacaaatgaacagcctgagagccgaggacacggctgtttattactgtgcgagagaaacttacgatttttggagttggttattatacaccccgggaccttgtac

SEQ ID NO: 456082 - DNA, 502 bp, Homo sapiens; identical to SEQ ID NO: 451572
  misc_feature: HEFZJCU01BQDKH.17.25.C03.1.454.heavy.3.raw

SEQ ID NO: 456083 - DNA, 512 bp, Homo sapiens
  misc_feature: HEFZJCU01EET9J.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtggggtggcagttgtttcatctgagggcagtgttcaatggtatgcagactccgtgaaggccgattcaccatctccagagacaattccaggaacacaatgtatttggaaatgaacagcctaagtcctgaggacacgggtgtatactactgtacgaaggagggggaaccaggcggagttccaagtactcctttg

SEQ ID NO: 456084 - DNA, 525 bp, Homo sapiens
  misc_feature: HEFZJCU01CPJZ3.14.35.D02.1.454.heavy.3.raw
cgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactgggccagggaaccctggtcaccgtctcctcagcctccaccaagggcccatcggtcttcccctcggcaccctcctccaagagcacctctgggggcacagcggcctggctgctggtcaaggactacttccg

SEQ ID NO: 456085 - DNA, 520 bp, Homo sapiens
  misc_feature: HEFZJCU01D2S0C.12.40.D07.1.454.heavy.3.raw
  modified_base (475)..(475): a, c, t, g, unknown or other
atacgacgtacacgaccggtgctcgatttagtgatagagcgtaacaacagagggctcaccatggagtttgggctgagctgggtttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattatttgcgcgagagagacacacgaacctactggccaatactatgggggcttgttctggggccaggggaccctggtcntcgtctccccagcctccaccaaggcccatcggtcttcccctggcg

SEQ ID NO: 456086 - DNA, 498 bp, Homo sapiens
  misc_feature: HEFZJCU01BVPWF.52.86.H09.1.454.heavy.3.raw
cgcagtacgacacgaccggtgctcgatttagtgctatagacttgggtttggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagc

SEQ ID NO: 456087 - DNA, 510 bp, Homo sapiens
  misc_feature: HEFZJCU01EIQUH.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactgggggcccgggagccctggt

SEQ ID NO: 456088 - DNA, 522 bp, Homo sapiens
  misc_feature: HEFZJCU01AROBH.13.25.C03.1.454.heavy.3.raw
tcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctgaggcctcagtgaaggtctcctgcaaggcttccggatacaccctcaatggaaactatgtccactatgtgcgacaggccccaggacaagggcttctgtggatggggtggatcaaccctaatagtggtgacacaaactatgagaagaaatttgagggccgggtcaccatgaccagggacacgtccatcaatacagccttcatggaactgaccagactgacctctgacgacacggccgtgtattactgtgcggtcgaaactcagcctaactactttgaattttgggggcctaggggagccctggtcaccgt

SEQ ID NO: 456089 - DNA, 504 bp, Homo sapiens
  misc_feature: HEFZJCU01CK86M.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatctgtatcttcacatgcacaatctgagagtcgacgacacggccacctattattgtgcgcgacatgactacgctcaattctggggccagggacg

SEQ ID NO: 456090 - DNA, 502 bp, Homo sapiens; identical to SEQ ID NO: 455512
  misc_feature: HEFZJCU01BSNKC.10.38.D05.1.454.heavy.3.raw

SEQ ID NO: 456091 - DNA, 402 bp, Homo sapiens; identical to SEQ ID NO: 444584
  misc_feature: HEFZJCU01EEEMV.10.77.G11.1.454.heavy.3.raw

SEQ ID NO: 456092 - DNA, 489 bp, Homo sapiens
  misc_feature: HEFZJCU01C7WXB.51.27.C05.1.454.heavy.3.raw
cgatcgtatacacgaccggtgctcgatttagacgcgatcgaagggtttggggagctctgggagacgagcccagcactggaagtcgccggtgtttccattcggtgatcatcactgaatacagaggactcaccatggagtttgggctgagctgggttttcctcgttgctcttttaagaggtgtccagtgttatgtgcagctggtggagtctgggggaggcgtggtccagcctgggaggtccctgagactcgcctgtacaccctctggattcaccttcagtaactatgcaatgcactgggtccgccaggctccaggcaaggggctggactgggtggcaggtatatcatatgatggaagcaataaatactacgcagactccgtgaagggccgattcaccatctccagagacagttccgatgacacagtctatctgcaaatgaacagcctgagagctgaggacacggcttctttttactgtgcgccaggaagca

SEQ ID NO: 456093 - DNA, 501 bp, Homo sapiens
  misc_feature: HEFZJCU01EHNBR.13.37.D04.1.454.heavy.3.raw
tcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagcccgaggaccacgggccgttttatcactgtgacgaaagatattgtaatga

SEQ ID NO: 456094 - DNA, 493 bp, Homo sapiens
  misc_feature: HEFZJCU01ADWXH.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagcgtgggttttcctcgttagctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagt

SEQ ID NO: 456095 - DNA, 509 bp, Homo sapiens; identical to SEQ ID NO: 444586
  misc_feature: HEFZJCU01DXN2C.12.78.H01.1.454.heavy.3.raw

SEQ ID NO: 456096 - DNA, 504 bp, Homo sapiens
  misc_feature: HEFZJCU01DK4LJ.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaaggccatcggtcttcccctggcaccctcctccaagagcacctctgggggcacagcggccctgggctgcctggtcaaggactacttccgagtagtaca

SEQ ID NO: 456097 - DNA, 510 bp, Homo sapiens
  misc_feature: HEFZJCU01DRRVC.9.14.B03.1.454.heavy.3.raw
tgatacgtctcacgaccggtgctcgatttagtgtgagtagtttgggtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccgttgacacttggggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 456098 - DNA, 517 bp, Homo sapiens; identical to SEQ ID NO: 445616
  misc_feature: HEFZJCU01D7AWS.9.34.D01.1.454.heavy.3.raw

SEQ ID NO: 456099 - DNA, 494 bp, Homo sapiens
  misc_feature: HEFZJCU01CC4EX.13.86.H09.1.454.heavy.3.raw
tcacgtactacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaaattactactta

SEQ ID NO: 456100 - DNA, 508 bp, Homo sapiens
  misc_feature: HEFZJCU01DPARM.4.67.G01.1.454.heavy.3.raw
  modified_base (448)..(448): a, c, t, g, unknown or other
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggcttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagaanccgaggacacggcccacatattactgtgcgaaagatctcgggctggttccgcgtccgggg

SEQ ID NO: 456101 - DNA, 520 bp, Homo sapiens
  misc_feature: HEFZJCU01EZXQ8.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtcccgccggcaagggactggagtatattggacgaatctatgccagtgggaccgccatctacaacccgtccctcaagagtcgagtcagcatgtcagtcgacaccgtcccagaaccagttctccctgacagtgagttatatgaccgccgcagacacggccgtgtattactgtgcgagagaggccgttattttaggaccagctagttaaaaactcctactacggtctggacgtctgtggccgagggaccg

SEQ ID NO: 456102 - DNA, 522 bp, Homo sapiens; identical to SEQ ID NO: 455299
  misc_feature: HEFZJCU01BJOUN.16.86.H09.1.454.heavy.3.raw

SEQ ID NO: 456103 - DNA, 520 bp, Homo sapiens
  misc_feature: HEFZJCU01AXE1X.9.34.D01.1.454.heavy.3.raw
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaacccgtggtcgccgtctcctcagcctccaccaagggcccatcggtcttccccctggcaccctcctccaagagcacctctgggggcacagcggccctgggctgcctggtcaaggactacttccagacgtatca

SEQ ID NO: 456104 - DNA, 503 bp, Homo sapiens; identical to SEQ ID NO: 445995
  misc_feature: HEFZJCU01AJVQZ.17.25.C03.1.454.heavy.3.raw

SEQ ID NO: 456105 - DNA, 509 bp, Homo sapiens
  misc_feature: HEFZJCU01CDWUG.52.38.D05.1.454.heavy.3.raw
cgcagtacgacacgaccggtgctcgatttagtatctgatagttgggtttggggaggtctcggagaggagccttagccctggactccaaggcctttccacttggtgatcagcactgagcacagaggactcaccatggagttggggctgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagtttcttgggatgttgtcgttgcacc

SEQ ID NO: 456106 - DNA, 519 bp, Homo sapiens; identical to SEQ ID NO: 453135
  misc_feature: HEFZJCU01D8DLK.16.10.A10.1.454.heavy.3.raw

SEQ ID NO: 456107 - DNA, 426 bp, Homo sapiens
  misc_feature: HEFZJCU01D05K8.9.34.D01.1.454.heavy.3.raw
tgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 456108 - DNA, 506 bp, Homo sapiens; identical to SEQ ID NO: 451216
  misc_feature: HEFZJCU01D2D4T.48.29.C07.1.454.heavy.3.raw

SEQ ID NO: 456109 - DNA, 509 bp, Homo sapiens
  misc_feature: HEFZJCU01DQPC2.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttcgtggggccagggacg

SEQ ID NO: 456110 - DNA, 411 bp, Homo sapiens
  misc_feature: HEFZJCU01A47L2.48.12.B01.1.454.heavy.3.raw
agtatacatacacgaccggtgctcgatttagtagtgtagattccgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggccccctggacacgggcttgagtggatgggatcgatcatccctttctctaatgtcacaagatacacacagagattccagggcagaatcacacttaccgcggacaaatccacgggcacagcgcagttgga

SEQ ID NO: 456111 - DNA, 519 bp, Homo sapiens
  misc_feature: HEFZJCU01DY8BX.14.57.F02.1.454.heavy.3.raw
cgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtattttgtgtgaaagatacgaagtctatgatacccaatttggaggggcctttcat

SEQ ID NO: 456112 - DNA, 526 bp, Homo sapiens; identical to SEQ ID NO: 446836
  misc_feature: HEFZJCU01DGH4G.11.25.C03.1.454.heavy.3.raw

SEQ ID NO: 456113 - DNA, 526 bp, Homo sapiens
  misc_feature: HEFZJCU01BDNQ3.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaacctggtcaccgtctccccacctccaccg

SEQ ID NO: 456114 - DNA, 499 bp, Homo sapiens
  misc_feature: HEFZJCU01DJ0K0.49.76.G10.1.454.heavy.3.raw
agtcgagagacacgaccggtgctcgatttagtcactcatacagggggcatcatccaacaaccacatcccttctctacagaagcctctgagaggaaagttcttcaccatggactggacctggagggtcttctgcttgctggctgtagctccaggtgctcacttccaggtgcagctggtgcagtctggggctgaggtgaagaagcctggggcctcagtgaaggtttcctgcaaggcatctggatacaccttgaccaactactatatacaatgggtgcgacaggcccctggacaaggacttgagtggatgggaataatcaaccctagcggtggaagtacaaccatcgcacagaaattccagggcagactcatcatgaccagggacacgtccacgagcaccgtctacatggaactgaacagcctgagatctgaggacactgccgtgtattactgtgcgagggagtaccgttttatcgtgggacgtgccccaaaatcaccgttt

SEQ ID NO: 456115 - DNA, 378 bp, Homo sapiens; identical to SEQ ID NO: 444419
  misc_feature: HEFZJCU01B6R8Q.47.77.G11.1.454.heavy.3.raw

SEQ ID NO: 456116 - DNA, 478 bp, Homo sapiens; identical to SEQ ID NO: 448105
  misc_feature: HEFZJCU01EHLNR.26.78.H01.1.454.heavy.3.raw

SEQ ID NO: 456117 - DNA, 516 bp, Homo sapiens
  misc_feature: HEFZJCU01CIKRR.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaacgggcccatccggtcttccccctggccgccctcgctccaggagcacctccgagagcacagcggccctggg

SEQ ID NO: 456118 - DNA, 392 bp, Homo sapiens; identical to SEQ ID NO: 444682
  misc_feature: HEFZJCU01D8UG9.16.70.G04.1.454.heavy.3.raw

SEQ ID NO: 456119 - DNA, 500 bp, Homo sapiens
  misc_feature: HEFZJCU01DMTOB.22.5.A05.1.454.heavy.3.raw
acatacgcgtcacgaccggtgctcgatttagatagatagacagggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcagcccccaggaaaggccctagactggcttgcactcatttattggaatgatgataagcgctacagcccatctctgaagagcagactcaacatcaccaaggacacctccaaaagcaagtggtccttacaatgaccaacatggaccctttggacacagccacatattactgtgcacaccacagggtctctactgctggctttcagtacaactggttcgaaccctggggccagggaaccctggtcagcgtctcctcagcctcc

SEQ ID NO: 456120 - DNA, 491 bp, Homo sapiens
  misc_feature: HEFZJCU01CFA5W.49.48.E04.1.454.heavy.3.raw
agtcgagagacacgaccggtgctcgatttagagagcgtcacagagagaagggggcatcatccaacaaccacatcccttctctacagaagcctctgagagggaagttcttcaccatggactggacctggagggtcttctgcttgctggctgtagctccgggtgctcactcccaggtgcagttggtgcagtctggggctgaggtgaagaagtctggggcctcagtgaagatttcctgcaaggcttctggataccccttcaccatctaccacatgcactgggtgcgacaggccccgggacaagggcttgagtggatgggaataatcaaccctagtggtggtagcacaacctccgcacagaggttccagggcagagtcaccatgaccagggacacgtccacgagcacattctacatggaactgagccgcctgagatctgacgacacggccgtgtactactgtgcgagagtcactcatttacacgatagttatggt

SEQ ID NO: 456121 - DNA, 503 bp, Homo sapiens
  misc_feature: HEFZJCU01B55GD.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaaggggcaat

SEQ ID NO: 456122 - DNA, 516 bp, Homo sapiens
  misc_feature: HEFZJCU01C23O3.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggcccatcggtcttccccctggccgccctgctctaggagctacc

SEQ ID NO: 456123 - DNA, 427 bp, Homo sapiens; identical to SEQ ID NO: 444708
  misc_feature: HEFZJCU01C5LSF.9.34.D01.1.454.heavy.3.raw

SEQ ID NO: 456124 - DNA, 503 bp, Homo sapiens; identical to SEQ ID NO: 445995
  misc_feature: HEFZJCU01CQHH7.17.25.C03.1.454.heavy.3.raw

SEQ ID NO: 456125 - DNA, 482 bp, Homo sapiens
  misc_feature: HEFZJCU01CVOUC.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagttccacgaagactgtgggaagggactgctggggccagggagcccttgtcaccgtctcctcagcctccaccaagggcccatcggtcttcccctgcgccctgctccaggagcacctccgagagcacagcggccctgggctgcctggtcaaggactacttcccactactatg

SEQ ID NO: 456126 - DNA, 514 bp, Homo sapiens
  misc_feature: HEFZJCU01D2KAN.13.87.H10.1.454.heavy.3.raw
tcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagatccaaccccttacgactttttggagttggttacg

SEQ ID NO: 456127 - DNA, 482 bp, Homo sapiens
  misc_feature: HEFZJCU01A4LAN.2.33.C11.1.454.heavy.3.raw
acgctcgacacacgaccggtgctcgatttagagtgagctcgttgggtttgggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccaagggcccatcggtcttcccctggcgcctgctccaggagcacctccgagagcacagcggccctgggctgcctggtcaaggactacttcctgtcgagcgt

SEQ ID NO: 456128 - DNA, 518 bp, Homo sapiens; identical to SEQ ID NO: 450369
  misc_feature: HEFZJCU01C7V2X.7.78.H01.1.454.heavy.3.raw

SEQ ID NO: 456129 - DNA, 509 bp, Homo sapiens
  misc_feature: HEFZJCU01D6YJU.26.12.B01.1.454.heavy.3.raw
agactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccagggaggggcctggagtgggtctcaggtatcagttacaatagtggtaatatactctatgcggactctgtgaagggccgattcaccatctccagagacaacgccaggaactccctctatctagaaatggacagtctgacaaccgaggacacggccttttattctgtgcaaaggtggaaccgacatatttcacaagctggcactggta

SEQ ID NO: 456130 - DNA, 400 bp, Homo sapiens; identical to SEQ ID NO: 444452
  misc_feature: HEFZJCU01C2HY4.47.24.C02.1.454.heavy.3.raw

SEQ ID NO: 456131 - DNA, 508 bp, Homo sapiens
  misc_feature: HEFZJCU01D28SQ.49.82.H05.1.454.heavy.3.raw
agtcgagagacacgaccggtgctcgatttagtcgagctctctcgcgggcacgaccggtgctcgatttagtcgatagtgaagggaaaggggctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaagccgggggggtccctgagactctcctgtgcagcctctggattcaccttccgttcctataccatgaactggatccgccaggctccagggaggcgactggagtgggtctcatctattagtggtagaggtgattactacaactacgcagactcactggaggccgattcaccatctccagagacaacaccaagaatttactgtatctgcaaatggacagcctgagagccgacgcacggctgtctattactgt

SEQ ID NO: 456132 - DNA, 516 bp, Homo sapiens
  misc_feature: HEFZJCU01EON5H.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggcctgggctgcctggtcaagactacttccagacgtatca

SEQ ID NO: 456133 - DNA, 502 bp, Homo sapiens
  misc_feature: HEFZJCU01BGMKH.48.34.D01.1.454.heavy.3.raw
agtatacatacacgaccggtgctcgatttagatcgtctgtgttgggctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgagggccgattcgccttctccagagacaattccaagagcacggttcatctgcaaatgagcgccctgagacctgacgacacggctgtctattactgtgcgagagggcgtccgagtttaacacgccgtcgggaggg

SEQ ID NO: 456134 - DNA, 514 bp, Homo sapiens; identical to SEQ ID NO: 446516
  misc_feature: HEFZJCU01DTZDU.12.55.E11.1.454.heavy.3.raw

SEQ ID NO: 456135 - DNA, 372 bp, Homo sapiens; identical to SEQ ID NO: 444513
  misc_feature: HEFZJCU01AU64C.5.23.C01.1.454.heavy.3.raw

SEQ ID NO: 456136 - DNA, 543 bp, Homo sapiens
  misc_feature: HEFZJCU01B08DU.13.35.D02.1.454.heavy.3.raw
tcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctggggggggcttggttaagcctggggggtccctcagactctcctgtgcaacctctggattcattttctctggacgcctggttgagctgggtccgccaggctcccgggaaggggctggagtgggttggccgtattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattactgtaccacagatgggccagatgcaaatggaccgcggacgacggttcgactactgggggcccgggaac

SEQ ID NO: 456137 - DNA, 489 bp, Homo sapiens; identical to SEQ ID NO: 444791
  misc_feature: HEFZJCU01A2H3H.47.85.H08.1.454.heavy.3.raw

SEQ ID NO: 456138 - DNA, 517 bp, Homo sapiens; identical to SEQ ID NO: 446891
  misc_feature: HEFZJCU01BYFVR.17.33.C11.1.454.heavy.3.raw

SEQ ID NO: 456139 - DNA, 533 bp, Homo sapiens
  misc_feature: HEFZJCU01EB3YI.15.87.H10.1.454.heavy.3.raw
tctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaaggtgagaaatactatgtggactctgtgaagggccgattcaccatctccagagacaacgccaagaacttactgtatctgcaaatgaacagcctgagaggcgaggacacggctctgtattactgtgcgaggatacctcctctggcgggccaggtttcctacggcatggacgtctggggccaagggaccacggtcaccgtctcctcagcctccaccaagggcccatcggtcttccccctggcaccctcctccaagagcacctctgggggcacagcggcctgggctgcct

SEQ ID NO: 456140 - DNA, 489 bp, Homo sapiens
  misc_feature: HEFZJCU01EQU7F.4.53.E09.1.454.heavy.3.raw
agcactgtagcacgaccggtgctcgatttagagagagtgtgttgggtttggggggtccctgagactctcctgtacagtctctgcatctaccttcacttctttttggatgacctggctccgccgggctccagggagggggctggagtgggtggccaccatcaatcaagatggaagtgagagaacctatgtggactctgtgaagggccgattcaccatctccagagacaacgccaagaattctctgtatctgcaaatgaacagcctgagagccgaggactcggctgtctattactgtgcgaggaagaagtattactatgatacaagtgacatgggctggttcgaccctggggccagggaaccctggtcaccgtctcctcagcctccaccaagggcccatcggtcttcccctggcgccctgctccaggagcacctcccgagagcacagccggccctgggctgcctggtcaaggactacttccctacagtgct

SEQ ID NO: 456141 - DNA, 498 bp, Homo sapiens
  misc_feature: HEFZJCU01CSHI8.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtgacgtggtagttccgggggacacatg

SEQ ID NO: 456142 - DNA, 536 bp, Homo sapiens
  misc_feature: HEFZJCU01CT4CY.51.26.C04.1.454.heavy.3.raw
cgatcgtatacacgaccggtgctcgatttagtctagcgactttgggtttgggctgagcgtggttttcctcgttagctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaaggggaccacggtcaccgtctcctttagcctccaccaagggcccatcggtcttcccctggcaccctcctccaagacgcacctctc

SEQ ID NO: 456143 - DNA, 519 bp, Homo sapiens
  misc_feature: HEFZJCU01A8ARH.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcacccctggggccagggaaccctggtcaccgtctcctcagcctccaccaagggcccatcggtcttcccctggcaccctcctccaagagcacctctgggggcacagcggccctgggctgcctggtcaaggactacttccgagtagtactac

SEQ ID NO: 456144 - DNA, 400 bp, Homo sapiens; identical to SEQ ID NO: 444452
  misc_feature: HEFZJCU01D5003.47.24.C02.1.454.heavy.3.raw

SEQ ID NO: 456145 - DNA, 430 bp, Homo sapiens; identical to SEQ ID NO: 444675
  misc_feature: HEFZJCU01EFS8P.40.34.D01.1.454.heavy.3.raw

SEQ ID NO: 456146 - DNA, 481 bp, Homo sapiens
  misc_feature: HEFZJCU01DNJE0.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgatttcaccatctccagggacaacgccaagaagtcactgtatctacaaatgaacagcctgagagccgaggacacggccgtgtattactgtgtgagagataagtccgggtatcacttggatagaagtgcttattacattgactactgggccagggaaccctcgtcaccgtctcctcagcctccaccaagggcccatcggtcttcccctggcaccctcctccaagagcacctctggggcacagcggccctgggctgcctggtcaaggactacttcctagagacacg

SEQ ID NO: 456147 - DNA, 487 bp, Homo sapiens; identical to SEQ ID NO: 447190
  misc_feature: HEFZJCU01C15HH.3.48.E04.1.454.heavy.3.raw

SEQ ID NO: 456148 - DNA, 518 bp, Homo sapiens
  misc_feature: HEFZJCU01A1ONN.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaagggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtattcc

SEQ ID NO: 456149 - DNA, 532 bp, Homo sapiens
  misc_feature: HEFZJCU01A0NGM.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttatggggcagggagcctggtcaccg

SEQ ID NO: 456150 - DNA, 537 bp, Homo sapiens; identical to SEQ ID NO: 451043
  misc_feature: HEFZJCU01DAP4O.48.14.B03.1.454.heavy.3.raw

SEQ ID NO: 456151 - DNA, 522 bp, Homo sapiens
  misc_feature: HEFZJCU01C5Y4F.48.76.G10.1.454.heavy.3.raw
agtatacatacacgaccggtgctcgatttagtcactcatacaggggtgggagaggagccccagccgtgagattcccaggagttttcacttggtgatcagccctgaaaacagaccaccaaccatggagtttgggcttaactgggttttccttgttgctattttaaaggtgcccaatgtgaggtgcagctggtggagtctgggggagccttggtacagccaggggggtccctgagactctcctgttcaacttctggattcacctttggtgattatattatgagttgggtccgccaggcgccagggaaggcactggagtgggttgctttcattagtcccaaactttctggtgggacagcatactacgccccgccagatatgccgcgtctgtgcaaggcagattcaccatgtcaagagatgaatccaaaggtatcgcctatctgcaaatgaacagcctgaaaaccgaggacacagccgtctattactgtactagagcctattttgtacatctggtgtattcacctt

SEQ ID NO: 456152 - DNA, 515 bp, Homo sapiens
  misc_feature: HEFZJCU01ETO9N.13.76.G10.1.454.heavy.3.raw
tcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattccaccatctccagagacaatccaagaacacgctgtttcttcaaatgaacagcctgagagccgatgacacggccgtgtattactgtgcgagagatggggcccacgaacgttactacgctatggacgtctggggccaagggaccg

SEQ ID NO: 456153 - DNA, 512 bp, Homo sapiens
  misc_feature: HEFZJCU01A0J6T.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgtggggccacgggaacctc

SEQ ID NO: 456154 - DNA, 483 bp, Homo sapiens; identical to SEQ ID NO: 453752
  misc_feature: HEFZJCU01CE1KR.19.53.E09.1.454.heavy.3.raw

SEQ ID NO: 456155 - DNA, 380 bp, Homo sapiens
  misc_feature: HEFZJCU01BML78.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctccgaggagcacagcggccctgggctgcctggtcaaggactacttcctacgtgagct

SEQ ID NO: 456156 - DNA, 529 bp, Homo sapiens; identical to SEQ ID NO: 446480
  misc_feature: HEFZJCU01D79VE.18.33.C11.1.454.heavy.3.raw

SEQ ID NO: 456157 - DNA, 329 bp, Homo sapiens
  misc_feature: HEFZJCU01B3AOU.10.12.B01.1.454.heavy.3.raw
catagtagtgcacgaccggtgctcgatttagtagtgtagattccgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttcccactactatg

SEQ ID NO: 456158 - DNA, 422 bp, Homo sapiens; identical to SEQ ID NO: 444734
  misc_feature: HEFZJCU01BMEJJ.16.78.H01.1.454.heavy.3.raw

SEQ ID NO: 456159 - DNA, 528 bp, Homo sapiens
  misc_feature: HEFZJCU01CQ3RO.12.33.C11.1.454.heavy.3.raw
atacgacgtacacgaccggtgctcgatttagagtgagctcgttgggtttgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcggggggaggtgtagtacggccgggggggtccctgagactctcatgtgcagggtctggattcaactttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctacaaatggacaatttgagagaggaagacacggccttatatttctgtgcgagagccctcggcagaagtctggactactactattatggtatggacgtctggggccg

SEQ ID NO: 456160 - DNA, 519 bp, Homo sapiens
  misc_feature: HEFZJCU01C1UC9.48.20.B09.1.454.heavy.3.raw
  modified_base (495)..(495): a, c, t, g, unknown or other
agtatacatacacgaccggtgctcgatttagtgtagtgtgaaggggggggcctggtaccgcctgggggtcccttagactctcctgtgcagcctctggattcatcttcagtaatgtctggatgacctggttccgccaggctccagggaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttccccctggcgccctcgctccaggagcacctccgacgagcacagcggccctgggcgtgcctggtcaaggactacttcctatgtatacctnagtggcggtcggcgaggacggcga

SEQ ID NO: 456161 - DNA, 518 bp, Homo sapiens; identical to SEQ ID NO: 444718
  misc_feature: HEFZJCU01EQSHF.9.34.D01.1.454.heavy.3.raw

SEQ ID NO: 456162 - DNA, 529 bp, Homo sapiens
  misc_feature: HEFZJCU01BLPWN.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaaggcccatcggtcttcccctggcaccctcctccaagagcacctctggggcacagcggccctgggctgcctc

SEQ ID NO: 456163 - DNA, 496 bp, Homo sapiens
  misc_feature: HEFZJCU01C0PI1.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcggccctgggctgcctggtcaaggactacttccctacagtgct

SEQ ID NO: 456164 - DNA, 499 bp, Homo sapiens
  misc_feature: HEFZJCU01D6RVF.12.79.H02.1.454.heavy.3.raw
atacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaatctcctgcaagtcttctggttacgcactcaccgccaatggtatcagctggctgcgacaggcccctggacaaggtcttgagtggatgtcatggatcagcactttcaatggagacacaaagtatggagagaacttccagggcagagtcaccatgaccactgacagatcaacgaacatagcctactggaactgagggcctgaggtctgacgacacggccctctattattgtgcgagattaatttcgtattgttctggtgtgtgtgttcaatgtttgaccatc

SEQ ID NO: 456165 - DNA, 487 bp, Homo sapiens
  misc_feature: HEFZJCU01AD3V4.51.1.A01.1.454.heavy.3.raw
cgatcgtatacacgaccggtgctcgatttagacgtctcatcaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccagactccaggcaaggggctggagtgggtggcagttatatcatatgatggaagtaatatatactatgtagactccgtgaagggccgattcatcatctccagagacaattccgagaacacgctgtatctgcaaatgaacagcctgagagttgaggacacggctgtgtattattgtgcgaacttaatcacggaggacaac

SEQ ID NO: 456166 - DNA, 505 bp, Homo sapiens
  misc_feature: HEFZJCU01ADWCV.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactaaaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggacaatgt

SEQ ID NO: 456167 - DNA, 512 bp, Homo sapiens
  misc_feature: HEFZJCU01C2NBV.48.12.B01.1.454.heavy.3.raw
agtatacatacacgaccggtgctcgatttagtagtgtagattccgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctggggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcggcggggaggtggacggagctcggttttcggagttatcatctactactttgaattc

SEQ ID NO: 456168 - DNA, 390 bp, Homo sapiens; identical to SEQ ID NO: 444541
  misc_feature: HEFZJCU01CKCC6.16.24.C02.1.454.heavy.3.raw

SEQ ID NO: 456169 - DNA, 538 bp, Homo sapiens
  misc_feature: HEFZJCU01ECQ7Y.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccaggggagcccctggtctaccg

SEQ ID NO: 456170 - DNA, 504 bp, Homo sapiens
  misc_feature: HEFZJCU01CR49J.49.38.D05.1.454.heavy.3.raw
agtcgagagacacgaccggtgctcgatttagtatctgatagttgggtttggggggaagaggaagactgacggtcctcccaggagttcaggtgctgggcaccgtgggcatgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaaggcccatcggtcttcccctggcgccctcgctcc

SEQ ID NO: 456171 - DNA, 519 bp, Homo sapiens; identical to SEQ ID NO: 446650
  misc_feature: HEFZJCU01ELZD1.13.76.G10.1.454.heavy.3.raw

SEQ ID NO: 456172 - DNA, 477 bp, Homo sapiens; identical to SEQ ID NO: 444659
  misc_feature: HEFZJCU01DJQSQ.16.10.A10.1.454.heavy.3.raw

SEQ ID NO: 456173 - DNA, 512 bp, Homo sapiens
  misc_feature: HEFZJCU01CS3DC.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttctaggtggctaattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattacgtgtgcgaaagcaccggcagttagtcacccatactactttgactactgggccg

SEQ ID NO: 456174 - DNA, 508 bp, Homo sapiens
  misc_feature: HEFZJCU01CNJVO.13.10.A10.1.454.heavy.3.raw
tcacgtactacacgaccggtgctcgatttagcgtcgatctcagggtcttcgtggctcacgtccaccaccacgcatgtgacctcagggagtccctgagactctcctgtgaagcctcaacattcacttttgctcgtgcctgggtgacctgggtccgccaggctccagggaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccgggaaccctggtcaccgtctcctcagcctccaccaagggcccatcggtcttccccctggcaccctcctccaagagcacctctgggggcacagcgccctgggctgcctggtcaggact

SEQ ID NO: 456175 - DNA, 519 bp, Homo sapiens
  misc_feature: HEFZJCU01DW7K2.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctgggtccagcctggggggtccctgagactctcctgttcagcctctggattcacctttagtaggttttggatgagttgggtccgccaggctccagggaagggctggagtgggtggccaacatagagtacgatggaagtgagaaaactatgtggactccgtgaagggccgattcaccatctccagagacaacgacaagaatttagtgtatctgcaaatgagcagcctgagagccgaggacacggctgtgtattattgtgcgag

SEQ ID NO: 456176 - DNA, 484 bp, Homo sapiens
  misc_feature: HEFZJCU01EZUSK.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggggcccttgtcaccgtctcctcagcctccaccaagggcccatcggtcttccccctggcgccctgctccaggagcacctccgagagcacagcggccctgggctgcctggtcaaggactacttcccactactatg

SEQ ID NO: 456177 - DNA, 535 bp, Homo sapiens
  misc_feature: HEFZJCU01CYE3Y.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggtttttgggggcgtcgggactccctctttgagtatcttgggggccaggggggacaaatggtcaccggtctctttcagt

SEQ ID NO: 456178 - DNA, 499 bp, Homo sapiens
  misc_feature: HEFZJCU01DJX37.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcttttgatgcctttgatatgtggggccaagggacaatggtcaccgtct

SEQ ID NO: 456179 - DNA, 507 bp, Homo sapiens
  misc_feature: HEFZJCU01C41S5.22.36.D03.1.454.heavy.3.raw
acatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctattttgggccgcggccgac

SEQ ID NO: 456180 - DNA, 528 bp, Homo sapiens
  misc_feature: HEFZJCU01DD78G.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaaggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtgctggtccactaggtttgactacgtggggccaggggaagcgtttggtccaccgtcctcctcagccctccc

SEQ ID NO: 456181 - DNA, 489 bp, Homo sapiens; identical to SEQ ID NO: 444591
  misc_feature: HEFZJCU01BLJ2I.18.70.G04.1.454.heavy.3.raw

SEQ ID NO: 456182 - DNA, 384 bp, Homo sapiens; identical to SEQ ID NO: 444454
  misc_feature: HEFZJCU01BCGNV.11.61.F06.1.454.heavy.3.raw

SEQ ID NO: 456183 - DNA, 384 bp, Homo sapiens; identical to SEQ ID NO: 444454
  misc_feature: HEFZJCU01AKHXN.11.61.F06.1.454.heavy.3.raw

SEQ ID NO: 456184 - DNA, 396 bp, Homo sapiens; identical to SEQ ID NO: 444469
  misc_feature: HEFZJCU01A0S1I.47.46.E02.1.454.heavy.3.raw

SEQ ID NO: 456185 - DNA, 398 bp, Homo sapiens; identical to SEQ ID NO: 444524
  misc_feature: HEFZJCU01A54WZ.7.60.F05.1.454.heavy.3.raw

SEQ ID NO: 456186 - DNA, 536 bp, Homo sapiens
  misc_feature: HEFZJCU01BL70R.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatccctgaaagcgtcaactactactactacggtatggacctctgggtaccg

SEQ ID NO: 456187 - DNA, 531 bp, Homo sapiens
  misc_feature: HEFZJCU01B1OLT.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacatcacctctccctgaggctgagctctgtgacagccgcggacacgggcgtttattacttgtgcgagagggacggactacggtgactactgggggttcgaccccgtgggggcccaggggaaccctggtcaccgtctcctcacgcctccaccg

SEQ ID NO: 456188 - DNA, 491 bp, Homo sapiens
  misc_feature: HEFZJCU01B5HI5.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgacca

SEQ ID NO: 456189 - DNA, 470 bp, Homo sapiens; identical to SEQ ID NO: 445307
  misc_feature: HEFZJCU01ED8FB.12.78.H01.1.454.heavy.3.raw

SEQ ID NO: 456190 - DNA, 501 bp, Homo sapiens; identical to SEQ ID NO: 445341
  misc_feature: HEFZJCU01BZRP0.48.34.D01.1.454.heavy.3.raw

SEQ ID NO: 456191 - DNA, 503 bp, Homo sapiens; identical to SEQ ID NO: 445995
  misc_feature: HEFZJCU01CVO9C.17.25.C03.1.454.heavy.3.raw

SEQ ID NO: 456192 - DNA, 512 bp, Homo sapiens
  misc_feature: HEFZJCU01A7T8L.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgtgtctcttttatttatagtagtggtagtacatactccgacagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctgggg

SEQ ID NO: 456193 - DNA, 514 bp, Homo sapiens
  misc_feature: HEFZJCU01DPXSI.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagccaagacagattttggagtggttactgttggactactttgactacgtggggccacgggaaccctggtcc

SEQ ID NO: 456194 - DNA, 386 bp, Homo sapiens
  misc_feature: HEFZJCU01CJYVJ.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaaacgagttctccctggacttgacctctgtgaccgccgcagacacggctgtttattactgtgcgagacgactacctgactccaatccatactttgactattggggccggggagccctggtcaccgtctccccaccctccaccaagggcccatcggtcttccccctggcaccctcctccaagagcacctctgggggcacagcggccctgggctgcctggtcaaggactacttcccatactcgta

SEQ ID NO: 456195 - DNA, 519 bp, Homo sapiens; identical to SEQ ID NO: 445330
  misc_feature: HEFZJCU01AMVA4.7.78.H01.1.454.heavy.3.raw

SEQ ID NO: 456196 - DNA, 498 bp, Homo sapiens
  misc_feature: HEFZJCU01AI2H8.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaatagaattgcaaacgatgcttttgatatgtggggacg

SEQ ID NO: 456197 - DNA, 507 bp, Homo sapiens
  misc_feature: HEFZJCU01BP3GZ.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccgggtgagccctacggcaggcggcctttgacttcgtc

SEQ ID NO: 456198 - DNA, 530 bp, Homo sapiens
  misc_feature: HEFZJCU01CECJX.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctgggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagaggggacggactacggtgactactgggggttcgaccccgtggggccaggggaaccctggtcaccgtctcctcagcctccaccg

SEQ ID NO: 456199 - DNA, 476 bp, Homo sapiens; identical to SEQ ID NO: 449487
  misc_feature: HEFZJCU01C0QZU.16.10.A10.1.454.heavy.3.raw

SEQ ID NO: 456200 - DNA, 536 bp, Homo sapiens
  misc_feature: HEFZJCU01DOP6D.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagtttgggctgagctgggttttccttgttgctattttaaaaggtgtccagtgtgaggtgcagctggtggagtccgggggaggcttggtccagcctggggggtccctgaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtggattacatttgggggagttatcgcaaacgggggggtacgtaaccg

SEQ ID NO: 456201 - DNA, 517 bp, Homo sapiens; identical to SEQ ID NO: 446078
  misc_feature: HEFZJCU01CMHFI.9.34.D01.1.454.heavy.3.raw

SEQ ID NO: 456202 - DNA, 506 bp, Homo sapiens
  misc_feature: HEFZJCU01C1LXB.16.38.D05.1.454.heavy.3.raw
tgtactactccacgaccggtgctcgatttagtatctgatagttgggtttgggctgggagacgagcccagcactggaagtcgccggtgtttccattcggtgatcagcactgaatacagaggactcaccatggagtttgggctgagcgtgggttttcctcgttactcttttaagaggtgtccaatgtcaggtgcagttggtggagtctgggggaggcgtggtccagcctggaaggtccctgagactctcgtgtgcagcgtctggattcatctttaatagttttcctatgcactggatccgccaggctccaggcaggggactggagtgggtggcaggagtgtcacttgatggagccaatacatacttcgcagactccgtgaagggccgattcaccatttccagagagaattccaacaacacgctgcatctgcaaatggacaccctgagacctgacgacacggctgtctattactgtgtgagactcttatgcgttcgggctttgactacg

SEQ ID NO: 456203 - DNA, 540 bp, Homo sapiens; identical to SEQ ID NO: 453794
  misc_feature: HEFZJCU01CJLWM.48.40.D07.1.454.heavy.3.raw

SEQ ID NO: 456204 - DNA, 493 bp, Homo sapiens
  misc_feature: HEFZJCU01BDKAG.52.15.B04.1.454.heavy.3.raw
cgcagtacgacacgaccggtgctcgatttagacagtatatatccgcggggtccagtgtcaggtgcagctggtggagtctgggggaggcgtggtccagcctgggaggtccctgagactctcctgtgcaggctctgcatttcccttcaataactatgctatcgattgggtccgccaggctccaggcaagggactggagtgggtggcagtaatatcagctgatggaggcactaaatattacgctgattctgcgagggccgattcaccatatccagagacaactcccaagatgtgatatatctacaaatgaacagcctgagacctgaggacacggctgtatattattgtgcgtcagggggcagtgcctggccacgtgatgcttttgatttctggggccaagggacattcgtcaccgtctcctcagcctccaccaagggcccatcggtcttcccctggcaccctcctccaagagcacctctgggggcacagcggcctc

SEQ ID NO: 456205 - DNA, 483 bp, Homo sapiens; identical to SEQ ID NO: 444932
  misc_feature: HEFZJCU01BJFS5.7.10.A10.1.454.heavy.3.raw

SEQ ID NO: 456206 - DNA, 512 bp, Homo sapiens; identical to SEQ ID NO: 450914
  misc_feature: HEFZJCU01AJ9AC.15.67.G01.1.454.heavy.3.raw

SEQ ID NO: 456207 - DNA, 510 bp, Homo sapiens
  misc_feature: HEFZJCU01ASG5T.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccattcatcatctccagagacaacgccgacaactcactgtctctgctgatgagcagcctgagagccgacgacacggctatctattactgtgcgaaactctcattccgttcatctgaatactggggccagggaaccctggtccgccg

SEQ ID NO: 456208 - DNA, 510 bp, Homo sapiens
  misc_feature: HEFZJCU01EHNM6.53.61.F06.1.454.heavy.3.raw
cgcgtatacacacgaccggtgctcgatttagctacgctctaagggaaaggggtcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcaccatctcgagagacaattccaggaacacgctgtatctgcaaatgaacggcctgagagctgaggacacggctgtgtattactgtgcgaaacggttgagtgggaattaggggctgagtacggtatggacgtcgtggggccaagggaccacggtcaccgtctcctc

SEQ ID NO: 456209 - DNA, 499 bp, Homo sapiens
  misc_feature: HEFZJCU01CZ7NA.9.30.C08.1.454.heavy.3.raw
tgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatacttaaactttgacttctggggccagggatccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 456210 - DNA, 498 bp, Homo sapiens
  misc_feature: HEFZJCU01DG4SS.49.21.B10.1.454.heavy.3.raw
agtcgagagacacgaccggtgctcgatttagtgtcgtcgcaagagggagacgagcccagcactggaaggcgccggtgtttccattcggtgatcagcactgaacacagaggactcaccatggagtttgggctgagctgggttttcctcgttggtcttttaagaggtgtccagtgttatgtgcagttggtggggtctgggggaggcgtggtccagcctgggaagtcactgagactcgcctgtacaccctctggattcaccttcagcaactatgcaatgcactgggtccgcctggctcccggcaagggtctggactgggtggcaggtatatcagctgatgggaccaaaatatactacgcaaactccgtgaagggccgattcaccatatcaagagacacttccgatgacacaatctatctgcaaatgaacagcctgaaagttgacgacacgggtctttttactgtgcgcctggaagcagtggctggccacatgatgcttttg

SEQ ID NO: 456211 - DNA, 501 bp, Homo sapiens; identical to SEQ ID NO: 445027
  misc_feature: HEFZJCU01DJAYW.26.23.C01.1.454.heavy.3.raw

SEQ ID NO: 456212 - DNA, 521 bp, Homo sapiens
  misc_feature: HEFZJCU01EZ9M3.51.40.D07.1.454.heavy.3.raw
cgatcgtatacacgaccggtgctcgatttagtgatagagcgtaacaacagagggggagactgagtgtgagtgaacatgagtgagaaaaactggatttgtgtggcactttctgataacggtgtccttctgtttgcaggtgtccagtgtcaggtgcagctcgtggagtctgggggaggcgtggtccagcctgggaggtccctgagactctcctgtgtagtctctggattcaccttcagggtgtacgacatgcactgggtccgccaggctccaggcaaggggctggagtgggtggcatttatatcacatgatggaagtaaaacatactatgcagagtccgtgaagggccgattcaccatctccagagacaattccaagaacacactgtttctgcacatgaaaagcctgagagctgaggacacggctgtttattactgtgcgtaacttaatcacggaggacaaaccggtaacccccgtcgctcgggtacggacgtctgggggccaaggggaccacgggtctaccg

SEQ ID NO: 456213 - DNA, 516 bp, Homo sapiens
  misc_feature: HEFZJCU01EUQ5G.10.53.E09.1.454.heavy.3.raw
catagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaaataaatactacagagactccgttcggggccgattcaccatctccaaagacaatttgaagaacacgctgttctgcaatgaacagcctgagagctgaggacacggctgtgtattactgttcgtttggttctgactcgtcgggggaataccttcagcactgggccgac

SEQ ID NO: 456214 - DNA, 503 bp, Homo sapiens
  misc_feature: HEFZJCU01E1PRU.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactact

SEQ ID NO: 456215 - DNA, 497 bp, Homo sapiens
  misc_feature: HEFZJCU01EJIU3.13.10.A10.1.454.heavy.3.raw
tcacgtactacacgaccggtgctcgatttagcgtcgatctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagttggaagtgagaaatactatgtggactctgtgaagggccgattcaccatctccagagacaacgccaagaactcactgtatctgcaaatgaacagcctgagagccgaggacacggctgtctattactgtgcgagagagttggggcggaaggtatagca

SEQ ID NO: 456216 - DNA, 392 bp, Homo sapiens
  misc_feature: HEFZJCU01BX02X.3.12.B01.1.454.heavy.3.raw
agacgcactccacgaccggtgctcgatttagtagtgtagattccgcgggttgtagtcggtgctcccaccatagtgggagcaccgactacaacccgtccctcaagagtcgagtcaccatatcagtagacacgtccaagaatcagatctccctgaacgtgacctctgtgacggccgcagacacggccgtctattactgtgccagttcgtcacatatgcttacgtctgggggagatatcgttttctctgacaactgggccagggttcctggtcaccgtctcctcagcctccaccaagggcccatcggtcttccccctggcaccctcctccaagagcacctctgggggcacagcggccctgggctgcctggtcaaggactacttccgagtgcgtct

SEQ ID NO: 456217 - DNA, 521 bp, Homo sapiens
  misc_feature: HEFZJCU01C8L4I.52.81.H04.1.454.heavy.3.raw
cgcagtacgacacgaccggtgctcgatttagtagtgtagattcgcgggggctctgggagaggagccccagccgtgagattcccaggagtttccacttggtgatcagcactgaacacagaccaccaaccatggagtttgggcttagctgggttttccttgttgctattttaaaaggtgcccaatgtgaggtgcagctggtggagtctgggggaggcttggtgcagccagggcggtccctgagactctcctgttcagcttccggagtcacctttggtcattatgctatgaactgggtccgccaggctccagggaagggcctgtcttgggtaggtttcattagaggcgacgcttttggtgggacaacagaatacgccgcgtctgtgaaaggcagattcaccatctcaagagatgattccaaaagcgtcgtctacttgcaaatgaacagcctgaaatccgaggacacagccgtgtattactgtactagagagtattggatcggggaaattactactccggtatgg

SEQ ID NO: 456218 - DNA, 379 bp, Homo sapiens; identical to SEQ ID NO: 444450
  misc_feature: HEFZJCU01CYAR8.47.77.G11.1.454.heavy.3.raw

SEQ ID NO: 456219 - DNA, 505 bp, Homo sapiens
  misc_feature: HEFZJCU01BFAHL.9.33.C11.1.454.heavy.3.raw
tgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatcctccagagaccaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 456220 - DNA, 398 bp, Homo sapiens; identical to SEQ ID NO: 444601
  misc_feature: HEFZJCU01ECLUV.4.79.H02.1.454.heavy.3.raw

SEQ ID NO: 456221 - DNA, 519 bp, Homo sapiens; identical to SEQ ID NO: 444867
  misc_feature: HEFZJCU01D0240.9.34.D01.1.454.heavy.3.raw

SEQ ID NO: 456222 - DNA, 396 bp, Homo sapiens; identical to SEQ ID NO: 444469
  misc_feature: HEFZJCU01EYYPP.47.46.E02.1.454.heavy.3.raw

SEQ ID NO: 456223 - DNA, 506 bp, Homo sapiens; identical to SEQ ID NO: 446520
  misc_feature: HEFZJCU01EQB7H.10.38.D05.1.454.heavy.3.raw

SEQ ID NO: 456224 - DNA, 502 bp, Homo sapiens
  misc_feature: HEFZJCU01C7ANY.17.10.A10.1.454.heavy.3.raw
  modified_base (284)..(284): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccgganaagggcttgagtgggtggggtggtcagcggctttgacggtaaggcacagtatgcaccgaagatgaagggcagagtcacgattaccacggaccacccccgacgaacacagtctacatgcaactgacgagcctgagagctgacgacacggccgtctattactgtgcgagaatgttttctgtcatcgtacaatttgatggctctatggactggacttcgtc

SEQ ID NO: 456225 - DNA, 523 bp, Homo sapiens
  misc_feature: HEFZJCU01BYOZU.9.30.C08.1.454.heavy.3.raw
tgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggagtgacctctgtgactgccgcagactcggccgtgtatttctgtgccagaacgcaaagcagcgcctactatactttaaactttgacttctggggcccaggggatcccgtggtcaccggtctcctca

SEQ ID NO: 456226 - DNA, 483 bp, Homo sapiens
  misc_feature: HEFZJCU01C76B7.52.8.A08.1.454.heavy.3.raw
cgcagtacgacacgaccggtgctcgatttagcatactctacagggggggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaactttaatcacggac

SEQ ID NO: 456227 - DNA, 522 bp, Homo sapiens
  misc_feature: HEFZJCU01DRT8D.53.81.H04.1.454.heavy.3.raw
cgcgtatacacacgaccggtgctcgatttagtagtgtagattcgcggggggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaagggactggagtgggtggcagttatatcatttgatggaagcactacatactacgcaaactccgtgaagggccgattcaccatctccagagacgattccaggaacactctgtttctccaaatgaacagcctgagagctgaggacacggctctttattactgtgcgagagattctggatacagccattattacttgcccggctactggggccaggggaccctggtcaccgtctcctcagcctccaccaagggcccatcggtcttcccctggcaccctcctccaagagcacctctgggggcacagcggcccg

SEQ ID NO: 456228 - DNA, 503 bp, Homo sapiens
  misc_feature: HEFZJCU01CBCSE.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggtccg

SEQ ID NO: 456229 - DNA, 511 bp, Homo sapiens
  misc_feature: HEFZJCU01EY1W1.10.38.D05.1.454.heavy.3.raw
catagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactttgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccaggggagcccg

SEQ ID NO: 456230 - DNA, 529 bp, Homo sapiens
  misc_feature: HEFZJCU01DEEBP.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaacttcaacctgacgacactgccgtttattttgtacgagagcgtcgtctgtcagtggaattgactactgggccagggaaccctggtcaccgtctcctcagcctccaccaaggg

SEQ ID NO: 456231 - DNA, 494 bp, Homo sapiens; identical to SEQ ID NO: 447658
  misc_feature: HEFZJCU01BDJ6C.4.21.B10.1.454.heavy.3.raw

SEQ ID NO: 456232 - DNA, 514 bp, Homo sapiens
  misc_feature: HEFZJCU01DROR4.14.9.A09.1.454.heavy.3.raw
cgtctagtaccacgaccggtgctcgatttagcgagacgcgcagggggggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctgggggaggtttggtacagccagggcggtccctgagactctcctgtataacttctggattcaacttgggtgattatgctatgaactgggtccgccaggctccagggaaggggctggagtgggtaggtttcattaggagcaattctcatgatgggacaacagaatacgccgcgtctgtaaaaggcagattcaccatctcaagagatgagtccagaagcatcgcctttctgcagatgagtagcctgaagaccgaggacacagccatctattactgtgctagagagtattgcagtcctacgacctgctagtgggggtccg

SEQ ID NO: 456233 - DNA, 493 bp, Homo sapiens
  misc_feature: HEFZJCU01DYSDN.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagcgtgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgt

SEQ ID NO: 456234 - DNA, 488 bp, Homo sapiens; identical to SEQ ID NO: 449258
  misc_feature: HEFZJCU01C6ZKW.12.53.E09.1.454.heavy.3.raw

SEQ ID NO: 456235 - DNA, 531 bp, Homo sapiens
  misc_feature: HEFZJCU01ELOK1.51.49.E05.1.454.heavy.3.raw
  modified_base (495)..(495): a, c, t, g, unknown or other
cgatcgtatacacgaccggtgctcgatttagagcgactagcaacacacaaagggggtggtttctgagagtcatggacctcctggacaagaacatgaaacccctgtggttcttcctcctcctggtggcagctcccagatgggtcctgtcccaggtgcaactgcagcagaggggcgcaagactgttgaagcctttggagaccctgtccctcacctgcactctttctggtgcgactttcagtggttatttctggggctgggtccgccagccccccgggaagggacttcagtggattggggaaatcagtcgtagtggagagaccttctacaacccgtccctcaagagtcgagtcgccatatcaacagacgcgtccaagagtgaggtgtccctgacactcaggtctgtgaccgccgcggacgcggctgtatactactgtgcgagacgtccccgctgggttttggagttggttattatgccggtatggacgtcgtggggcncgagggaccacggtcgccgtctcttcagcctccacc

SEQ ID NO: 456236 - DNA, 525 bp, Homo sapiens; identical to SEQ ID NO: 453961
  misc_feature: HEFZJCU01BNXE5.12.86.H09.1.454.heavy.3.raw

SEQ ID NO: 456237 - DNA, 506 bp, Homo sapiens; identical to SEQ ID NO: 444696
  misc_feature: HEFZJCU01AH0OT.16.34.D01.1.454.heavy.3.raw

SEQ ID NO: 456238 - DNA, 518 bp, Homo sapiens; identical to SEQ ID NO: 444718
  misc_feature: HEFZJCU01C6RB5.9.34.D01.1.454.heavy.3.raw

SEQ ID NO: 456239 - DNA, 512 bp, Homo sapiens
  misc_feature: HEFZJCU01BYWXS.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaagggctggagtgggtggccaacataaacaaagacggaagtcagaaaaactatgtggactctgtgaacggccgattcaccatctccagagacaacgccaagaattcactgtatttgcaaatgaacagcctgagaggcgaggacacgggccgtgtattattgtgcgcgagatgatagtagactctacagtagcaggtggta

SEQ ID NO: 456240 - DNA, 482 bp, Homo sapiens
  misc_feature: HEFZJCU01APKCL.49.8.A08.1.454.heavy.3.raw
agtcgagagacacgaccggtgctcgatttagcatactctacaggggagctctgggagaggagcccagcactagaagtcggcggtgtttccattcggtgatcagcactgaacacagaggactcaccatggagtttgggcttgagctgggttttcctcgttgctcttttaagaggtgtccagtgtcaggtgcagcgtggtggagtctgggggaggcgtggtccagcctgggaggtccctgagactctcctgtgcagcctctggattcaccttcagggtctatgacatgcactgggtccgccaggctccaggcaaggggctggagtgggtggcaggttatatcatatgatggaagcaatatatactatgtagactccgtgaagggccgattcatcatctccagagacaattccgagaacacgctgtatctgcaaatgaacagcctgagagctgaggacacggctgtgtattactgtgcgaacttt

SEQ ID NO: 456241 - DNA, 524 bp, Homo sapiens; identical to SEQ ID NO: 445902
  misc_feature: HEFZJCU01A5GY3.9.78.H01.1.454.heavy.3.raw

SEQ ID NO: 456242 - DNA, 533 bp, Homo sapiens
  misc_feature: HEFZJCU01BLR9W.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagagtgggggccccacggaacgttactacgctatggacgtcgtgggggccaagggaccacc

SEQ ID NO: 456243 - DNA, 513 bp, Homo sapiens
  misc_feature: HEFZJCU01C0I8A.52.71.G05.1.454.heavy.3.raw
  modified_base (441)..(441): a, c, t, g, unknown or other
cgcagtacgacacgaccggtgctcgatttagtgtcgtcgcaagagagaggggggagagaggagcccagccctgggattttcaggtgttttcatttggtgatcaggactgaacagagagaaatcaccatggagtttgggctgagcgtggcttttcttgtggctattttaaaaggtggccaatgtgaggtgcagctggtggagtctgggggaggcttggtacagcccggggggtccctgagactctcctgtgcagcctctggattcagttttaccagctatgccatggcctgggtccgccaggctccagggaaggggctggagtgggtctcaggtattagtggtagtgctatgaccacattctacgcagctccgtgaagggccggttcaccatttccagagacaattccaagagtaccctgtatctgcaatgaacagcctganagccgacgacacggccgtatattactgtgcgaagcaattactctatggacattatgggcccattgactactc

SEQ ID NO: 456244 - DNA, 379 bp, Homo sapiens; identical to SEQ ID NO: 444450
  misc_feature: HEFZJCU01DC0XK.47.77.G11.1.454.heavy.3.raw

SEQ ID NO: 456245 - DNA, 500 bp, Homo sapiens
  misc_feature: HEFZJCU01EXDEY.17.10.A10.1.454.heavy.3.raw
  modified_base (459)..(459): a, c, t, g, unknown or other
cgtagactagcacgaccggtgctcgatttagcgtcgatctcagggacccaaaaaccacacccctccttgggagaatcccctagatcacagctcctcaccatggactgggcctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttcngtcatcgtacaatttgataggctctatggactggacttctc

SEQ ID NO: 456246 - DNA, 527 bp, Homo sapiens
  misc_feature: HEFZJCU01AW1AF.48.57.F02.1.454.heavy.3.raw
agtatacatacacgaccggtgctcgatttagctcgatatagttgggtttggggagtgactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttcttggccaacatgcaccctgtggacacggccacttatttttgtacacacaccatcttgacgactggggatgtcttttctatttctggggccgaggggaccgtggtcgccgtgtctacagcctccaccaagggcccatcggtcttcccctc

SEQ ID NO: 456247 - DNA, 504 bp, Homo sapiens; identical to SEQ ID NO: 446177
  misc_feature: HEFZJCU01CF30G.15.55.E11.1.454.heavy.3.raw

SEQ ID NO: 456248 - DNA, 515 bp, Homo sapiens
  misc_feature: HEFZJCU01BNNJV.10.87.H10.1.454.heavy.3.raw
catagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtctgggggaggcgtggtccagcctggggggtccctgagactctcctgtgcagcctctggattcgacttcgaaatgtctggcatgcactgggtccgccaggctccaacgaaggggctggagtgggtggcagttctttcatttgatgaaaaaagggatattatgcgacctccgtgaagggccgattcagcatctccagagacatttccaaggccacggtgtatctgcaaatgaccagcctgagaagtgaggacacggctatgtactattgtgcgaaggaccttccacctgaactaatatggggggctttgaacact

SEQ ID NO: 456249 - DNA, 532 bp, Homo sapiens
  misc_feature: HEFZJCU01DRA8P.9.30.C08.1.454.heavy.3.raw
tgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttcgtggggccagggactcccgtggtccaccgtctcctcacgcctccg

SEQ ID NO: 456250 - DNA, 505 bp, Homo sapiens
  misc_feature: HEFZJCU01CYY3G.51.36.D03.1.454.heavy.3.raw
cgatcgtatacacgaccggtgctcgatttagctgcgtcacgatctctcttggggatgctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagactattactactggggctggatccggcagccccccgggaaggggctggattggattggcagtatcagttatactgggaccaccttcttcaagtcgtcgctcaagagtcgagtcaccatgaccgcggacacgtccaaggaccagttctccctgaagctgacctctgtgaccgccgcagacacggctttgtatttctgtgctagatataatgtgggtgacagtggtgcctactacggagtcttttgattatttggggccaaggg

SEQ ID NO: 456251 - DNA, 513 bp, Homo sapiens
  misc_feature: HEFZJCU01EVJWK.13.21.B10.1.454.heavy.3.raw
tcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttggggccggggacctggtcaccgtcaac

SEQ ID NO: 456252 - DNA, 501 bp, Homo sapiens
  misc_feature: HEFZJCU01AIN7L.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctcggcgccctcgctccaggagcacctccgagagcacagcggccctgggcgtgcctggtcgaaggacgtacttccctacagtgct

SEQ ID NO: 456253 - DNA, 506 bp, Homo sapiens
  misc_feature: HEFZJCU01BPFQ8.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctccgagagcacagcggccctgggctgcctggtcaaggactactcgagtgcgtct

SEQ ID NO: 456254 - DNA, 498 bp, Homo sapiens
  misc_feature: HEFZJCU01D0PV7.53.80.H03.1.454.heavy.3.raw
cgcgtatacacacgaccggtgctcgatttagctgtgcgtcgaagggaaagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcaccatctcgagagacaattccaggaacacgctgtatctgcaaatgaacggcctgagagctgaggacacggctgtgtattactgtgcgaaacggtttgagtgggata

SEQ ID NO: 456255 - DNA, 504 bp, Homo sapiens
  misc_feature: HEFZJCU01EXMT8.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggacg

SEQ ID NO: 456256 - DNA, 510 bp, Homo sapiens
  misc_feature: HEFZJCU01EFRUJ.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgtttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 456257 - DNA, 512 bp, Homo sapiens
  misc_feature: HEFZJCU01A30P7.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagcgtgcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 456258 - DNA, 527 bp, Homo sapiens
  misc_feature: HEFZJCU01DQW1X.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtcccgtgacgactacggcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatcggtcttcccctggccg

SEQ ID NO: 456259 - DNA, 519 bp, Homo sapiens; identical to SEQ ID NO: 445330
  misc_feature: HEFZJCU01BQGXG.7.78.H01.1.454.heavy.3.raw

SEQ ID NO: 456260 - DNA, 526 bp, Homo sapiens
  misc_feature: HEFZJCU01AEPAP.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatccctgaaagcgtcaactactactactacggtatggacctc

SEQ ID NO: 456261 - DNA, 528 bp, Homo sapiens
  misc_feature: HEFZJCU01A0M9T.12.40.D07.1.454.heavy.3.raw
  modified_base (309)..(309): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtnaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatcggtcttcccctggccgcctcg

SEQ ID NO: 456262 - DNA, 514 bp, Homo sapiens
  misc_feature: HEFZJCU01BTCM6.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaaggccgattcaccatctccagagacaattccaggaacacaatgtatttggagctgaacagcctaagtcctgaggacacgggcgtatactactagtacgaaggaggggggaaccgagcggagttccaagtactccttgtacg

SEQ ID NO: 456263 - DNA, 513 bp, Homo sapiens
  misc_feature: HEFZJCU01EXMJA.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatcctccagagacaattccaagaacacactgtatctgcaaatgaacagcctgagagccgacgacacggccatatattactgtgcgaaagcaccggcagttagtcacccatactactttgactacgtggggaccg

SEQ ID NO: 456264 - DNA, 492 bp, Homo sapiens
  misc_feature: HEFZJCU01D8RVU.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaaggccgattcaccatctccagagacaattccaagaacacgcagtatctgcaaatgaacagcctgagagctgaggacacggctgtgtattctgtgggagagatgggaggtcgatattgta

SEQ ID NO: 456265 - DNA, 522 bp, Homo sapiens
  misc_feature: HEFZJCU01A1TX7.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagccctccaccaagggcccatcggtcttcccctggcg

SEQ ID NO: 456266 - DNA, 505 bp, Homo sapiens
  misc_feature: HEFZJCU01EN842.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttcccctggcaccctcctccaagagcacctctgggggcacagcggccctgggctgcctggtcaaggactacttcctagtacgta

SEQ ID NO: 456267 - DNA, 520 bp, Homo sapiens
  misc_feature: HEFZJCU01D54V3.48.34.D01.1.454.heavy.3.raw
agtatacatacacgaccggtgctcgatttagatcgtctgtgttgggtttggggatttagatgtctgtgttgggtttggggggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggcgccctgcctccaggagcaccctccgagagcacagcggccctcgggctgcctggtcaaggactacttcctatgtata

SEQ ID NO: 456268 - DNA, 503 bp, Homo sapiens
  misc_feature: HEFZJCU01E05CS.48.52.E08.1.454.heavy.3.raw
agtatacatacacgaccggtgctcgatttagtcgagctctcagagaggtgccttagccctggattccaaggcatttccacctggtgatcagcactgaacacagaggactcaccatggaggtggggctgtgctgggtgttccttgttgctattttagaaggtgtccaatgtgaggtgcagctggtggaatctgggggtgccttggtgccgccgggggggtccctgagactctcctgtgtagcctccggattcacatttagttcccatagtatggtctgggtccgccaggctccagggaagggtctagagtggatttcatacattaggagtggcagtagtcccatatactacgcagactctgtgaagggccgattcatcatctccagagacaatgccgagaactcactgtttctgcaaatgaacagcctgagagacgaggacacggctgtttattactgtgcgagagtgcggatttcacctacacagggctggttcgaccccgtc

SEQ ID NO: 456269 - DNA, 502 bp, Homo sapiens
  misc_feature: HEFZJCU01B6GEW.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaaccacagtctacatgcaactgacgagcctgagagctgacgacacggccgtctattactgtgcgagaatgttttctgtcatcgtacaatttgataggctctatggactggacttctc

SEQ ID NO: 456270 - DNA, 532 bp, Homo sapiens
  misc_feature: HEFZJCU01DR5CH.7.78.H01.1.454.heavy.3.raw
cgtgtctctacacgaccggtgctcgatttagtgtgagtagtttgggtttggggacccaacgaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcgtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaaggg

SEQ ID NO: 456271 - DNA, 513 bp, Homo sapiens
  misc_feature: HEFZJCU01C38W2.13.71.G05.1.454.heavy.3.raw
tcacgtactacacgaccggtgctcgatttagtgtcgtcgcaagagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggggcttggtccagcctggggggtccctgagactctcctgtgcagcctctggattcacttttagtaggtattggatgggttgggtccgccagactccagagaagggactggagtgggtggccaacataaaggaagatggaagtgaaagatactatgtggactctgtgaagggccgattcaccatctccagagacaacgccaagaactcactgtatctgcagatgaccagcctgagagtcgaggatacggctgtgtattattgtgcgagagatgggggcacgacattttgtagaggtgtactgggggccaggggacg

SEQ ID NO: 456272 - DNA, 507 bp, Homo sapiens; identical to SEQ ID NO: 455428
  misc_feature: HEFZJCU01A32YQ.13.37.D04.1.454.heavy.3.raw

SEQ ID NO: 456273 - DNA, 508 bp, Homo sapiens; identical to SEQ ID NO: 445288
  misc_feature: HEFZJCU01DFF79.51.43.D10.1.454.heavy.3.raw

SEQ ID NO: 456274 - DNA, 510 bp, Homo sapiens
  misc_feature: HEFZJCU01CETW4.48.59.F04.1.454.heavy.3.raw
agtatacatacacgaccggtgctcgatttagtacacacacttagggattggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagccgcagtggctttttgatgcctttgatatgtgggccaagggacaatggtcaccgtctctcagcctccaccaaggccc

SEQ ID NO: 456275 - DNA, 504 bp, Homo sapiens
  misc_feature: HEFZJCU01DMFZX.49.20.B09.1.454.heavy.3.raw
agtcgagagacacgaccggtgctcgatttagtgtagtgtgaaggggacccaacaaccacatccctcctcagaagcccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatggatcaccgctggcaatggtgacacaaaatattcagagaagttccagggcagagtctccattaccagggacacagctgcgagtacagggtacatggaactgagtggcctgagatctgaggacacggctgtttattactgtgcgagaggggaatgggatattgtggcagctccaggtgcccagccgggccctactttgactac

SEQ ID NO: 456276 - DNA, 506 bp, Homo sapiens
  misc_feature: HEFZJCU01BLAGJ.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcacctcctccaagagcacctctgggggcacgagcggccctgggctgcctggtcaaggactacttccgagtagtaca

SEQ ID NO: 456277 - DNA, 521 bp, Homo sapiens
  misc_feature: HEFZJCU01A2OOJ.12.71.G05.1.454.heavy.3.raw
  modified_base (370)..(370): a, c, t, g, unknown or other
  modified_base (374)..(374): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcaccagaggttccagggcagagtcaccattaccgcggacgaggccacgaagacagtctacatggaattgagcagcctgagatttgacgacacggccatgtattactgtgcgagggagggccagctgctgggagcgtntacntatttcgacccctggggccagggaacccaggtcaccgtctcctcagcctccaccaagggcccatccgtcttcccctgcgccctgctccaggagcacctccgagagcacagcggccctgggctgcctggtcaaggactacttcctacg

SEQ ID NO: 456278 - DNA, 500 bp, Homo sapiens
  misc_feature: HEFZJCU01DI9ML.51.83.H06.1.454.heavy.3.raw
cgatcgtatacacgaccggtgctcgatttagatcacgtgcgtcgcggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggactcgtgggggagcgtggtccagcctgggaggtccctgcgactctcctgtgcagcctctggattcagcttcagggctaatactatgttctgggtgcgccaggctccaggcaaggggctggagtgggtggcagtcatctggcctgatggaggtttaacattactatgcggactccgtggagggccgattcaccgtctccagagacaactccaaaaacacgctgtatctccaaatgaacagcctcagatctgaggacacggctatctactactgtgtgaaagaattgggtttcagtggctacttt

SEQ ID NO: 456279 - DNA, 378 bp, Homo sapiens; identical to SEQ ID NO: 444419
  misc_feature: HEFZJCU01BWROW.47.77.G11.1.454.heavy.3.raw

SEQ ID NO: 456280 - DNA, 532 bp, Homo sapiens; identical to SEQ ID NO: 445228
  misc_feature: HEFZJCU01AYVK1.7.78.H01.1.454.heavy.3.raw

SEQ ID NO: 456281 - DNA, 515 bp, Homo sapiens; identical to SEQ ID NO: 445422
  misc_feature: HEFZJCU01EQ5NR.4.57.F02.1.454.heavy.3.raw

SEQ ID NO: 456282 - DNA, 536 bp, Homo sapiens
  misc_feature: HEFZJCU01DBOM5.13.65.F10.1.454.heavy.3.raw
tcacgtactacacgaccggtgctcgatttagctacgctctaagggggggagaggagcccagcactgggattccgaggtatttccattcggtgatcagcactgaacacagaggactcaccatggagttttggctgagctgggtttccttattactattttaaaaggtgtccagtgtgaggtgcagttggtggagtctggaggaggcttggtccagccgggggggtccctgagactctcatgtgcggcctctgggctcaccgtcaacaccaactacatgagctgggtccgccaggctccagggaagaggccggagtgggtctcagttatttatgtcgacggtgccacattctacgcagactccgtgaggggccggttcaccatctccagagacaattccaagaacacggtgtatcttcaaatgaacgacctgagagtcgaggacacggccgtctattactgtgcgaagatgcagagagggccccgtaatgggggcctggtggagggttcttctttgactgctggggccagggaacctc

SEQ ID NO: 456283 - DNA, 506 bp, Homo sapiens
  misc_feature: HEFZJCU01CXXKU.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggccatcggtcttcccctggcgcctgctccaggagcacctctggggcacagcggcctgggctgcctggtcaaggactacttccata

SEQ ID NO: 456284 - DNA, 396 bp, Homo sapiens
  misc_feature: HEFZJCU01D204L.48.44.D11.1.454.heavy.3.raw
agtatacatacacgaccggtgctcgatttagcgcagtacgaaggggcgattcaccttctccagaggcaattccaagaacaccctgtgtcttcgtgggtctcatttctttatagcggtgttaggacaacctacgcagactccgtgaaggggcgattcaccttctccagaggcaattccaagaacaccctgtatcttcaaactaaacagtctaagagccgaggacacggccctgtgttacggccggtgacggaaccggtggctagcggggccagggaaccctggctcagcctccaccaagggcccatcggtcttccccctggcaccctcctccaagagcacctctgggggcacagcggccctgggctgcctggtcaaggactacttcctatgtatact

SEQ ID NO: 456285 - DNA, 393 bp, Homo sapiens; identical to SEQ ID NO: 449969
  misc_feature: HEFZJCU01CGGMX.5.70.G04.1.454.heavy.3.raw

SEQ ID NO: 456286 - DNA, 437 bp, Homo sapiens
  misc_feature: HEFZJCU01CET6T.51.5.A05.1.454.heavy.3.raw
cgatcgtatacacgaccggtgctcgatttagatagatagacaggggccctcctggaagggacaggagcgcgcaagggtgagtcagaccctcctgccctcgatggcaggtggagaagattcagaaaggtctgagatccccgggacgcagcaccactgtcaatggggggccccagacgcctggaccagggcctgcgtgggaaaggcctctgggcacactcaggggctttttgtgaagggtccgcctactgtgtgactacggtaaatacgttaattcttctactacgatatggacgtctggggccaagggaccacggtcaccgtctcttcagcctccaccaagggcccatcggtcttccccctggcaccctcctccaagagcacctctggggcacagcggccctgggctgcctggtcaaggactacttcctcgtagcact

SEQ ID NO: 456287 - DNA, 512 bp, Homo sapiens
  misc_feature: HEFZJCU01BCHGU.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccgaggcaagggcttggagtggctggcagttgtttcatctgaaggaagtgttcaatactatacagactccgtgaagggccgattcaccatctccagagacaattccaagaacacgatgtatctgcaaatggacagcctaagagttgtaggacacggctgtttattactgtacgaaaggaaggggggatacagtggcgagctccaagtacttac

SEQ ID NO: 456288 - DNA, 385 bp, Homo sapiens; identical to SEQ ID NO: 444438
  misc_feature: HEFZJCU01ECKLX.18.60.F05.1.454.heavy.3.raw

SEQ ID NO: 456289 - DNA, 473 bp, Homo sapiens
  misc_feature: HEFZJCU01EQSIW.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctgacgacaccggccgtatatttctgt

SEQ ID NO: 456290 - DNA, 514 bp, Homo sapiens
  misc_feature: HEFZJCU01BLAKS.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtgggccggggaaccctggtcaccgtctcttcagcctccaccaagggcccatcggtcttcccctggcaccctcctccaagagcacctctgggggcac

SEQ ID NO: 456291 - DNA, 496 bp, Homo sapiens
  misc_feature: HEFZJCU01EXVYD.53.26.C04.1.454.heavy.3.raw
cgcgtatacacacgaccggtgctcgatttagtctagcgactttgggtttgggggcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacagggccatcagaacagcctacatggagctgaacagactgacatctgacgacacggccgtttattattgtgtagtagagaggacccgatcgacctcggt

SEQ ID NO: 456292 - DNA, 497 bp, Homo sapiens; identical to SEQ ID NO: 445391
  misc_feature: HEFZJCU01ESOO4.3.26.C04.1.454.heavy.3.raw

SEQ ID NO: 456293 - DNA, 506 bp, Homo sapiens; identical to SEQ ID NO: 444696
  misc_feature: HEFZJCU01EP5SL.16.34.D01.1.454.heavy.3.raw

SEQ ID NO: 456294 - DNA, 513 bp, Homo sapiens; identical to SEQ ID NO: 456007
  misc_feature: HEFZJCU01A6VYY.14.25.C03.1.454.heavy.3.raw

SEQ ID NO: 456295 - DNA, 546 bp, Homo sapiens
  misc_feature: HEFZJCU01BUKD5.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggcttttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgccctataatggtggttggatcggggagtttggttccgtggggccagggaaccctggtcctaccg

SEQ ID NO: 456296 - DNA, 493 bp, Homo sapiens
  misc_feature: HEFZJCU01AUKJ2.51.78.H01.1.454.heavy.3.raw
cgatcgtatacacgaccggtgctcgatttagtgtgagtagtttgggtttgggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactactctcgtagcact

SEQ ID NO: 456297 - DNA, 520 bp, Homo sapiens; identical to SEQ ID NO: 451524
  misc_feature: HEFZJCU01EBL94.14.57.F02.1.454.heavy.3.raw

SEQ ID NO: 456298 - DNA, 519 bp, Homo sapiens
  misc_feature: HEFZJCU01DJ7CU.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctgggccagggaaccctggtcaccgtctcctcagcctccaccaacgggcccatcggtcttcccctggccaccctcctccaagagcacctctggggcacagcggcctgggctgcctggtcaaggactacttccgagtagtacacg

SEQ ID NO: 456299 - DNA, 511 bp, Homo sapiens
  misc_feature: HEFZJCU01D49QN.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactcgtgaaggccgattcacatctccagagacaattccaggaacacaatgtatttggaaatgaacagcctaagtcctgaggacacgggtgtatactactgtacgaaggaggggggaaccaggcgggagttccaagtactcctttg

SEQ ID NO: 456300 - DNA, 530 bp, Homo sapiens
  misc_feature: HEFZJCU01CQ6HR.48.26.C04.1.454.heavy.3.raw
agtatacatacacgaccggtgctcgatttagtctagcgactttgggtttggggggaagaggaagactgacggtccccccaggagttcaggtggtgcagtctggagctgaggtgaagaagcctggggcctcagtgaacgtctcctgcaaggcttctggttacaccttttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttactatggttcggggagtctccgacccagcaactggttcgacccgtggggccagggaaccctggtcaccgtctcctcagcctccaccaagggcccatcggtcttcccctcggcaccctcctccaagacgcacctctgggggcacac

SEQ ID NO: 456301 - DNA, 503 bp, Homo sapiens; identical to SEQ ID NO: 451156
  misc_feature: HEFZJCU01EWBOI.26.80.H03.1.454.heavy.3.raw

SEQ ID NO: 456302 - DNA, 516 bp, Homo sapiens
  misc_feature: HEFZJCU01BTUY6.48.34.D01.1.454.heavy.3.raw
agtatacatacacgaccggtgctcgatttagatcgtctgtgttgggtccagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggcgccctgctccaggagcacctccgagagcacagcggccctgggctgcctggtcaaggactacttccta

SEQ ID NO: 456303 - DNA, 477 bp, Homo sapiens; identical to SEQ ID NO: 444659
  misc_feature: HEFZJCU01CWLW8.16.10.A10.1.454.heavy.3.raw

SEQ ID NO: 456304 - DNA, 525 bp, Homo sapiens
  misc_feature: HEFZJCU01CVHEI.17.34.D01.1.454.heavy.3.raw
  modified_base (508)..(508): a, c, t, g, unknown or other
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctccttgacttctgggcntggaaccccgtcaccgt

SEQ ID NO: 456305 - DNA, 498 bp, Homo sapiens
  misc_feature: HEFZJCU01BYMJR.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagactctgtgaagggccgattcatcatctccagagacaatggcaacaactcactgtatctggaaatcaacagcctgagagtcgaggacacggctgtatattattgtgcgagagccccctacggtgacg

SEQ ID NO: 456306 - DNA, 518 bp, Homo sapiens
  misc_feature: HEFZJCU01ERBLR.40.9.A09.1.454.heavy.3.raw
tctagcgactcacgaccggtgctcgatttagcgagacgcgcaggggaggtctcagagaggagccttagccctggactccaaggcctttccacttggtgatcagcactgagcacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaaactatgcggactctgtgaagggccgattcaccatttccagagacaacgccaagaagtcactctctctacacatgaccagcctgacagccgaggacacggctgtttattactgtgcgagagatggcacgtcgggggcggtgactttgactacgtggggccac

SEQ ID NO: 456307 - DNA, 378 bp, Homo sapiens; identical to SEQ ID NO: 444463
  misc_feature: HEFZJCU01BQH64.47.77.G11.1.454.heavy.3.raw

SEQ ID NO: 456308 - DNA, 489 bp, Homo sapiens
  misc_feature: HEFZJCU01AOVWQ.19.53.E09.1.454.heavy.3.raw
tactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctgcgccctgctccaggagcacctccgagagcacagcggccctgggctgcctggtcaaggactacttcccacgagagta

SEQ ID NO: 456309 - DNA, 493 bp, Homo sapiens
  misc_feature: HEFZJCU01BTVHK.49.23.C01.1.454.heavy.3.raw
agtcgagagacacgaccggtgctcgatttagtacacgtgattagggattgggcacgtgattagggattgggcaccgtgggcatgggggaggtgtgtcacaagatttgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacagtctgagacgtgaagacacggctgtctattactgtgcgactgagatgtcttattacgatgccagtgctttagtaccgttcgaccctggggccagggagccctggtcaccgtctcctcagcttccaccaaggcccatcggtcttcccctggcgcctgctccagagcacctcgtgggc

SEQ ID NO: 456310 - DNA, 372 bp, Homo sapiens; identical to SEQ ID NO: 444513
  misc_feature: HEFZJCU01EEO77.5.23.C01.1.454.heavy.3.raw

SEQ ID NO: 456311 - DNA, 504 bp, Homo sapiens
  misc_feature: HEFZJCU01ECQQQ.48.22.B11.1.454.heavy.3.raw
agtatacatacacgaccggtgctcgatttagacgacagctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattggggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcagtggctttttgatgcctttgattatggtggggccaagggacaatggtcaccgtcttcc

SEQ ID NO: 456312 - DNA, 525 bp, Homo sapiens
  misc_feature: HEFZJCU01CZE37.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccagggggacctttggggtttcgacccctggggccagggaaccctggtcaccgtctcctcagcctccaccaagggcccatcggtcttcccctggccaccctcctccaagagcacctctgggggcacagcc

SEQ ID NO: 456313 - DNA, 522 bp, Homo sapiens
  misc_feature: HEFZJCU01EKPRP.47.78.H01.1.454.heavy.3.raw
agctcacgtacacgaccggtgctcgatttagtgtgagtagtttgggtttggggctctctgagagtcagggacctcctgcattagcacatgaaacacctgtggttcttccgcctcctggtgacagctcccagatttgactgcctcaggaatgccgatttgaagatgtgagatgctgcctctgatcccaggactcactgcgggtttctctgttcacaggggtcctgtcccaggtgcaaccacaccactggggcgcaggactgttgaagccttcggagaccctgtccctcacctgcgctgtctgtggtgggtccttcagtgactactactgagactagatccgccagtccccagggaagggctggaatggattcgacaggtcaatcattacagatccaccaactacaacccgtcctcagcagtcgagtcaccttttcgcttgacacgtccaacaaccagttttctctgaatcaaaacccgagaccgccgcggacacgcctcggccctcggggcccagtaaacccg

SEQ ID NO: 456314 - DNA, 504 bp, Homo sapiens
  misc_feature: HEFZJCU01D6N1I.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcgcctggctgcctggtcaggactactcctacgtcgtat

SEQ ID NO: 456315 - DNA, 482 bp, Homo sapiens
  misc_feature: HEFZJCU01D8SAU.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggccaccctcctccaagagcacctctggggcacagcggccctgggctgcctggtaaggactacttccgtatctctcg

SEQ ID NO: 456316 - DNA, 523 bp, Homo sapiens; identical to SEQ ID NO: 451418
  misc_feature: HEFZJCU01BAEM0.12.40.D07.1.454.heavy.3.raw

SEQ ID NO: 456317 - DNA, 418 bp, Homo sapiens; identical to SEQ ID NO: 446028
  misc_feature: HEFZJCU01B3TM7.16.28.C06.1.454.heavy.3.raw

SEQ ID NO: 456318 - DNA, 477 bp, Homo sapiens; identical to SEQ ID NO: 452630
  misc_feature: HEFZJCU01CHKP1.26.78.H01.1.454.heavy.3.raw

SEQ ID NO: 456319 - DNA, 530 bp, Homo sapiens
  misc_feature: HEFZJCU01ETURG.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaaccg

SEQ ID NO: 456320 - DNA, 493 bp, Homo sapiens
  misc_feature: HEFZJCU01CP89T.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctgacgacacggccgtgtattactgtgcgagaggttttatgatacttatgtagtggtggtacctgctacttttc

SEQ ID NO: 456321 - DNA, 486 bp, Homo sapiens; identical to SEQ ID NO: 444861
  misc_feature: HEFZJCU01CCCCO.47.55.E11.1.454.heavy.3.raw

SEQ ID NO: 456322 - DNA, 510 bp, Homo sapiens
  misc_feature: HEFZJCU01EYV05.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgacttactggggccagggaaccctggtcaccgtctcttcagcctccaccaagggcccatcggtcttccccctggccaccctcctccaggagccacctccgagagcacagcggccctgggctgcctggtcaaggactacttcctagtacgtga

SEQ ID NO: 456323 - DNA, 495 bp, Homo sapiens
  misc_feature: HEFZJCU01A3186.51.71.G05.1.454.heavy.3.raw
cgatcgtatacacgaccggtgctcgatttagtgtcgtcgcaagagagagggggagctctgggagacgagcccagcactggaagtcgccggtgtttccattcggtgatcatcactgaacacagaggactcaccatggagtttgggctgagcgtggtttcgtcgttaggctctttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgatac

SEQ ID NO: 456324 - DNA, 511 bp, Homo sapiens
  misc_feature: HEFZJCU01A3O3Y.17.25.C03.1.454.heavy.3.raw
  modified_base (435)..(435): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggatcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacncggccgtctattactgtgcgagagtcccacgatccggtgagccctacgggcaggccggccctttggacctttcgtc

SEQ ID NO: 456325 - DNA, 522 bp, Homo sapiens
  misc_feature: HEFZJCU01CXHAN.21.76.G10.1.454.heavy.3.raw
tcgtcgctcgcacgaccggtgctcgatttagtcactcatacaggggctgggagaggagcccagcactgggattccgaggtgtttccattcggtgatcagcactgaacacagaggactcaccatggagttttggctgagctgggttttccttgttactatttcaaaaggtgtccagtgtgaggtgcagctggtggagactggaggagacttgatccaacctggggggtccctgagactctcctgtgcggtctctgggttcaccgtcactactaactccatgagctgggtccgccaggctccagggaaggggctggagtgggtctcagttatttatagtggtggtggtgcagattacgcagactccgtgaagggccgattcaccatctccagagacaattccatgaacacgctgtatcttcaaatgaacagcctgagagccgacgacacggccgtctattactggtgcggacggggagtggacgggggagggagggctagtggtattacgttcgaaccgacggt

SEQ ID NO: 456326 - DNA, 521 bp, Homo sapiens
  misc_feature: HEFZJCU01C0VUD.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacgaaccgttactacgctatggacgtcgtggggccaaggggaccg

SEQ ID NO: 456327 - DNA, 530 bp, Homo sapiens
  misc_feature: HEFZJCU01B5AQB.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcctttttacacctcccttgacttctggggccatggaaccccggtccg

SEQ ID NO: 456328 - DNA, 542 bp, Homo sapiens
  misc_feature: HEFZJCU01C40V7.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgttgggggcagttttacttgtaccccgtgggggcccggggaaccctgggtcaccggtctccccacccctccaacccg

SEQ ID NO: 456329 - DNA, 483 bp, Homo sapiens
  misc_feature: HEFZJCU01CIJCJ.52.32.C10.1.454.heavy.3.raw
cgcagtacgacacgaccggtgctcgatttagtatagacatcaacacacaaagggggggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaacttaa

SEQ ID NO: 456330 - DNA, 524 bp, Homo sapiens; identical to SEQ ID NO: 445902
  misc_feature: HEFZJCU01ERWVT.9.78.H01.1.454.heavy.3.raw

SEQ ID NO: 456331 - DNA, 396 bp, Homo sapiens; identical to SEQ ID NO: 444469
  misc_feature: HEFZJCU01E09ES.47.46.E02.1.454.heavy.3.raw

SEQ ID NO: 456332 - DNA, 511 bp, Homo sapiens; identical to SEQ ID NO: 455069
  misc_feature: HEFZJCU01CCOR4.4.25.C03.1.454.heavy.3.raw

SEQ ID NO: 456333 - DNA, 508 bp, Homo sapiens
  misc_feature: HEFZJCU01EY4JV.10.28.C06.1.454.heavy.3.raw
catagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgtatgtggaaatgaacagtctgagagccgaggacacggctctctattactgtgcgagacgaccccgaaatac

SEQ ID NO: 456334 - DNA, 508 bp, Homo sapiens; identical to SEQ ID NO: 449436
  misc_feature: HEFZJCU01ASUR2.12.78.H01.1.454.heavy.3.raw

SEQ ID NO: 456335 - DNA, 518 bp, Homo sapiens; identical to SEQ ID NO: 449255
  misc_feature: HEFZJCU01BN22V.3.17.B06.1.454.heavy.3.raw

SEQ ID NO: 456336 - DNA, 523 bp, Homo sapiens; identical to SEQ ID NO: 446270
  misc_feature: HEFZJCU01AP71R.12.40.D07.1.454.heavy.3.raw

SEQ ID NO: 456337 - DNA, 494 bp, Homo sapiens
  misc_feature: HEFZJCU01B1A8E.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctgggccgtggcacctggtcactgtctcctcggcttccaccagggcccatcggtcttcccctggccgccctgctccaggagcacctc

SEQ ID NO: 456338 - DNA, 483 bp, Homo sapiens; identical to SEQ ID NO: 444639
  misc_feature: HEFZJCU01BGL7S.11.23.C01.1.454.heavy.3.raw

SEQ ID NO: 456339 - DNA, 359 bp, Homo sapiens; identical to SEQ ID NO: 445991
  misc_feature: HEFZJCU01DWLEI.14.39.D06.1.454.heavy.3.raw

SEQ ID NO: 456340 - DNA, 512 bp, Homo sapiens
  misc_feature: HEFZJCU01CF9BP.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtgcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggagggggaaccgagcgggagtcaagtactcctttgtacg

SEQ ID NO: 456341 - DNA, 507 bp, Homo sapiens; identical to SEQ ID NO: 446637
  misc_feature: HEFZJCU01BLQPK.16.34.D01.1.454.heavy.3.raw

SEQ ID NO: 456342 - DNA, 354 bp, Homo sapiens
  misc_feature: HEFZJCU01E1PW9.51.26.C04.1.454.heavy.3.raw
cgatcgtatacacgaccggtgctcgatttagtctagcgactttgggtttgggattcacgttgcagatgtaggtctgtgtggctggggacagggacgccggctgcctctgctctgtggttgggccatgtgacccattcgagtgtcctgcacgggcacaggtttgtgtctgggcaggaacagctactgtgtccctgtgtgctgcttttgatatctggggccaagggacaatggtcaccgtctcttcagcctccaccaagggcccatcggtcttccccctggcaccctctccaagagcacctctgggggcacagcggccctgggctgcctggtcaaggactacttcctcgtagcact

SEQ ID NO: 456343 - DNA, 501 bp, Homo sapiens; identical to SEQ ID NO: 452399
  misc_feature: HEFZJCU01A6CTC.40.81.H04.1.454.heavy.3.raw

SEQ ID NO: 456344 - DNA, 402 bp, Homo sapiens
  misc_feature: HEFZJCU01AUI5A.51.45.E01.1.454.heavy.3.raw
cgatcgtatacacgaccggtgctcgatttagtgagtcagtaagggaaaggggctggaatgggtggcagttatttcgtccactggaaacagtaaacattatggacgctccgtgaagggcccattcgccatctccagagacaattccaaaaataccctctatctgcgaatgaacagcctgcgacctgaagacacggctatatatttctgtgcgagaggggagtcttattgtaatgatggttcctgctatcgttttgacttctggggccagggaaccctggtcaccgtctcctcagcctccaccaagggcccatcggtcttccccctggcaccctcctccaagagcacctctgggggcacagcggccctgggctgcctggtcaaggactatttcctcgtagcact

SEQ ID NO: 456345 - DNA, 485 bp, Homo sapiens
  misc_feature: HEFZJCU01CQDHR.51.6.A06.1.454.heavy.3.raw
cgatcgtatacacgaccggtgctcgatttagatctactgacaggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgcagtctgggggagcgtggtccagcctgggaggtccctgagactctcctgtgaagcctctggattcagcttcagtacgtatggtttgcgctgggtccgccaggctccaggcaagggactgcagtgggtggcatctatatcatatgaaggaagcaataaatactacgcagactccgtgaagggccgattcaccatctccagagacaatcccaagaacacactttatctgcaaatgaacaccctgagacttgaggacacggctgtctattattgtgcgagagggagatcgatcac

SEQ ID NO: 456346 - DNA, 521 bp, Homo sapiens
  misc_feature: HEFZJCU01EFZMV.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttccccctggcgccctgctccaggagcacctccgagagcacagcggccctgggctgcctggtcaggactacttcctacg

SEQ ID NO: 456347 - DNA, 508 bp, Homo sapiens
  misc_feature: HEFZJCU01DBMJL.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggcgtggcacctggtcactgtctcctcggcttccaccaagggcccatcggtcttcccctgcgcctgctccagagcacctctggggcacagcggcccg

SEQ ID NO: 456348 - DNA, 513 bp, Homo sapiens; identical to SEQ ID NO: 445134
  misc_feature: HEFZJCU01CXQ81.3.34.D01.1.454.heavy.3.raw

SEQ ID NO: 456349 - DNA, 499 bp, Homo sapiens
  misc_feature: HEFZJCU01D1LDV.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagattttctatagaggtgactacgggggcgttcg

SEQ ID NO: 456350 - DNA, 506 bp, Homo sapiens
  misc_feature: HEFZJCU01CCN30.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggccctgggctgcctggtcaaggactacctccgagtagtaca

SEQ ID NO: 456351 - DNA, 512 bp, Homo sapiens
  misc_feature: HEFZJCU01BGSLO.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctcgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccac

SEQ ID NO: 456352 - DNA, 484 bp, Homo sapiens
  misc_feature: HEFZJCU01BVPHD.19.53.E09.1.454.heavy.3.raw
tactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacgggccttgtattactgtgcaaggaggtatagc

SEQ ID NO: 456353 - DNA, 518 bp, Homo sapiens
  misc_feature: HEFZJCU01D405Y.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagagcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggccaccctcctccaagagcacctctgggggcacagcggccctgggctgcctggtcaaggactactccagacgtatca

SEQ ID NO: 456354 - DNA, 534 bp, Homo sapiens
  misc_feature: HEFZJCU01CVTOZ.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctggggcccgggaaccctggtcaccgtctcctcagctccaccaagggcccatcggtcttcccctggcaccctcctccaagacg

SEQ ID NO: 456355 - DNA, 491 bp, Homo sapiens
  misc_feature: HEFZJCU01BHSG2.19.53.E09.1.454.heavy.3.raw
tactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtatttactgtgcaaggaggtat

SEQ ID NO: 456356 - DNA, 511 bp, Homo sapiens
  misc_feature: HEFZJCU01CT5DA.13.87.H10.1.454.heavy.3.raw
tcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgacaaagataccaccccttacgattttggagtggttacg

SEQ ID NO: 456357 - DNA, 498 bp, Homo sapiens
  misc_feature: HEFZJCU01CC9NJ.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgaggctgtgagcgccgcagacacggccgtgtattactgtgcgagactggccgcaacagactacggtggcaactcctatgcttttgatatctggggccaagggc

SEQ ID NO: 456358 - DNA, 500 bp, Homo sapiens; identical to SEQ ID NO: 446033
  misc_feature: HEFZJCU01AWSDZ.11.27.C05.1.454.heavy.3.raw

SEQ ID NO: 456359 - DNA, 515 bp, Homo sapiens
  misc_feature: HEFZJCU01ACUS1.3.55.E11.1.454.heavy.3.raw
agacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgatggaagaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccagggaaccctggtcaccgtctcctcagcctccaccaagggcccatcggtcttcccctggcaccctcctcc

SEQ ID NO: 456360 - DNA, 501 bp, Homo sapiens
  misc_feature: HEFZJCU01CTCXS.13.85.H08.1.454.heavy.3.raw
tcacgtactacacgaccggtgctcgatttagtatcactcagtcgcgggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagtttgagcagcctgagatctgacgacacggccgttttattactgtgcgcgagataatagtcacaactggaacggcgttttggggtggttc

SEQ ID NO: 456361 - DNA, 501 bp, Homo sapiens
  misc_feature: HEFZJCU01DXS4S.53.22.B11.1.454.heavy.3.raw
cgcgtatacacacgaccggtgctcgatttagacgacagctcagggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcacgccctacg

SEQ ID NO: 456362 - DNA, 515 bp, Homo sapiens
  misc_feature: HEFZJCU01DJ79W.26.71.G05.1.454.heavy.3.raw
agactatactcacgaccggtgctcgatttagtgtcgtcgcaagagagaggggggggggaagaggaagactgacggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctccaaagaccgggtggtccttacaatgaccgacatgaatcctgtggacacaggcacatattactgtgcacacagtcctagcggctacgcgagaaaagaatatgactattggggccagggaattttggtcaccgtctccccagcctccaccaagggcccatcggtcttcccctggcgccctgctccaggagcacctccgagagcacagcggccctgggctgcctggtcaaggactactt

SEQ ID NO: 456363 - DNA, 390 bp, Homo sapiens; identical to SEQ ID NO: 447143
  misc_feature: HEFZJCU01C8V6B.48.70.G04.1.454.heavy.3.raw

SEQ ID NO: 456364 - DNA, 483 bp, Homo sapiens; identical to SEQ ID NO: 451760
  misc_feature: HEFZJCU01C25TH.19.71.G05.1.454.heavy.3.raw

SEQ ID NO: 456365 - DNA, 498 bp, Homo sapiens
  misc_feature: HEFZJCU01D9H48.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccaggggaaccctgggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 456366 - DNA, 491 bp, Homo sapiens; identical to SEQ ID NO: 445531
  misc_feature: HEFZJCU01BY605.11.38.D05.1.454.heavy.3.raw

SEQ ID NO: 456367 - DNA, 510 bp, Homo sapiens
  misc_feature: HEFZJCU01EVJET.48.27.C05.1.454.heavy.3.raw
agtatacatacacgaccggtgctcgatttagacgcgatcgaagggtttggggtctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggat

SEQ ID NO: 456368 - DNA, 497 bp, Homo sapiens
  misc_feature: HEFZJCU01EMW41.48.71.G05.1.454.heavy.3.raw
agtatacatacacgaccggtgctcgatttagtgtcgtcgcaagagagaggggggatcacataacaaccacattcctcctctaaagaagtccctgggagcacagctcttcaccatggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcatccctatgtttaagagaatcaggcgtgctgagaagttcgaggacagagtcacctttatggcggacgaatcctcgagcacagtctatatggatctggccagcctgaagtctagaagacacgggcatatatttctgtgcgacagatggtcgtggattctcgtctgctttatgggaa

SEQ ID NO: 456369 - DNA, 490 bp, Homo sapiens
  misc_feature: HEFZJCU01CGMN9.48.20.B09.1.454.heavy.3.raw
agtatacatacacgaccggtgctcgatttagtgtagtgtgaagggggagcacaattgaaaaagcccggggagtctctgaagatctcctgtgagggttctggatacagctttgccaactactggatcgcctgggtgcgccagatgcccgggaaaggcctggagtggatggggatcatctatcctggcgactctgataccagatacagcccgtccttccaaggccaagtcaccatctcagccgacaactccatcagcaccgcctacctgcagtggagcagcctgaaggcctcggacaccgccgtgtattactgtgcgagacatgattacggctactcacgtccgcactactggggccagggaaccctggtcaccgtctcctcagcttccaccaagggcccatcggtcttcccctggcgccctgctccaggagcacctctgggggcacagcggccctgggctgcctggtcaaggactacttcctatgtatact

SEQ ID NO: 456370 - DNA, 506 bp, Homo sapiens
  misc_feature: HEFZJCU01CNP5G.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaactcaatgatagaaatcagggatgggggccagggaaccctggtcaccgtctcctcagcctccaccaagggcccatcggtcttcccctggcgcctgctccaggagcacctccgagagcacagcggccctgggctgcctggtcaaggactacttccgagtgcgtct

SEQ ID NO: 456371 - DNA, 409 bp, Homo sapiens
  misc_feature: HEFZJCU01DLLQ6.51.31.C09.1.454.heavy.3.raw
cgatcgtatacacgaccggtgctcgatttagacgtctcatcaaggaaggaaggggctggagtgggtctcaatgatcagtgatggtggaacgaccacaaactacgccgactccgtgaagggccggtgcaccatctccagagacaattcgaaggacacttttatatctgcaaactcaacagactgacacccgcggacacggccgtctactactgtgtgaaagaagacggaccgctggacgaggagccagaggagaatcactactttgactactgggccagggaagactggtcaccgtctcctccgcctccaccaagggcccatcggtcttccccctggcaccctcctccaagagcacctctggggcacagcggcctgggctgcctggtcaaggactacttctcgtagcact

SEQ ID NO: 456372 - DNA, 523 bp, Homo sapiens
  misc_feature: HEFZJCU01C7A3T.11.25.C03.1.454.heavy.3.raw
cgagagataccacgaccggtgctcgatttagtagtgtagatttgggtttggggagagagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggccacgaacgttactacgctatggacgtctggggccaagggacctac

SEQ ID NO: 456373 - DNA, 512 bp, Homo sapiens; identical to SEQ ID NO: 445688
  misc_feature: HEFZJCU01ARHUW.3.34.D01.1.454.heavy.3.raw

SEQ ID NO: 456374 - DNA, 519 bp, Homo sapiens
  misc_feature: HEFZJCU01B7INZ.51.34.D01.1.454.heavy.3.raw
cgatcgtatacacgaccggtgctcgatttagatcgtctgtgttgggtttggggagctctgagagaggagcccagccctgggattttcaggtgttttcatttggtgatcaggactgaacagagagaactcaccatggagtttgggctgagcgtggcttttcttagtggctattttaaaaggtggccagtgtgaggtgcagctgttagagtctgggggaggcttggtccagcctggggggtccctcagactctcctgtgcagcctcgggaattatatttaagaactttgccatgagttgggtccgccaggctccagggaaggggctggaatgggtctccactattagtggcagcggtgatgacacattctacacagactccgtgaggggccgtttcaccatctccagagacaatgccaaagacagctctatctggaagtgaagagcctgagagtcgaggacacggccgtcttttattgtgtgaagggcgtgggacttatcttcaggaccatattacttgta

SEQ ID NO: 456375 - DNA, 499 bp, Homo sapiens
  misc_feature: HEFZJCU01EDJMT.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctggaaccccga

SEQ ID NO: 456376 - DNA, 531 bp, Homo sapiens
  misc_feature: HEFZJCU01C883O.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttccccctggccgccctcgctccaggagcacctccgagagcacagcggccctggggccg

SEQ ID NO: 456377 - DNA, 524 bp, Homo sapiens
  misc_feature: HEFZJCU01A8THG.12.55.E11.1.454.heavy.3.raw
  modified_base (479)..(479): a, c, t, g, unknown or other
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccagtcgtcccttcccgtggccncctgcctaccgaggacgcctacctcggtcgggcacgcggccgtcc

SEQ ID NO: 456378 - DNA, 493 bp, Homo sapiens; identical to SEQ ID NO: 455531
  misc_feature: HEFZJCU01CACLT.47.85.H08.1.454.heavy.3.raw

SEQ ID NO: 456379 - DNA, 504 bp, Homo sapiens
  misc_feature: HEFZJCU01DIPC5.51.45.E01.1.454.heavy.3.raw
cgatcgtatacacgaccggtgctcgatttagtgagtcagtaagggaaaggggagctctgggagacgagcccagcactcgaagtcgccggtgtttccattcggtgatcatcactgaacacagaggactcaccatggagtttgggctgagctgggttttcctcgttgctcttttaagaggtgtccagtgtcaggtgcggctggtggagtctgggggaggcgtggtccagcctggggattccctgagaatctcctgtgcagcctctggattcaacttcaatagacatcctatgcactgggtccgccaggctccaggcaaggggctggaatgggtggcagttatttcgtccactggaaacagtaaacattatggacgctccgtgaagggcccattcgccatctccagagacaattccaaaataccctctatctgcgaatgaacagcctgcgacctgaagacaggctatatatttctgtgcgagaggggagtcttattgtaatgatggt

SEQ ID NO: 456380 - DNA, 493 bp, Homo sapiens; identical to SEQ ID NO: 453100
  misc_feature: HEFZJCU01AFT7E.14.25.C03.1.454.heavy.3.raw

SEQ ID NO: 456381 - DNA, 512 bp, Homo sapiens
  misc_feature: HEFZJCU01EBSVY.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaagggaggggggaaccaggcgggatttccaagtactcctttg

SEQ ID NO: 456382 - DNA, 515 bp, Homo sapiens
  misc_feature: HEFZJCU01DQNGR.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcacctcgtgggggcacagcggcccg

SEQ ID NO: 456383 - DNA, 512 bp, Homo sapiens
  misc_feature: HEFZJCU01DKG20.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgagggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagctccaccaaggcccatcggtcttcccctggcaccctcctccaagagcacctctgggggcacagcggcctgggctgcctggtcaggactacttccagacgtatca

SEQ ID NO: 456384 - DNA, 492 bp, Homo sapiens; identical to SEQ ID NO: 447948
  misc_feature: HEFZJCU01CD8DU.10.29.C07.1.454.heavy.3.raw

SEQ ID NO: 456385 - DNA, 512 bp, Homo sapiens
  misc_feature: HEFZJCU01EZ7WO.51.17.B06.1.454.heavy.3.raw
cgatcgtatacacgaccggtgctcgatttagtcgatagtgaaggggcagtgactcctgtgccccaccatggacacactttgctccacgctcctgctgctgaccatcccttcatgggtcttgtcccagatcaccttgaaggagtctggtcctacactggtgaaacccacacagaccctctcgctgacctgcgccttctctgggttctcactcagcagtagtggagtgggtgtgggctggatccgtcagcccccaggaaaggccctggagtgggttgcactcatttattggaatgatgaaagccgctacagcccatctctgaagagcaggctcaccatctcgaggggcaggtccgaaaaccaggtgatccttacgatgagtaacttggaccctgtggacacagccacatattactgtgcacacaggttcggcgatttttggagtggttattcaaaccctacttcgacttctggggcccgggaatcctggtcaccgtctcctcagcctccaccac

SEQ ID NO: 456386 - DNA, 527 bp, Homo sapiens
  misc_feature: HEFZJCU01DE0I1.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaagggcccatcggtcttcccctggcaccctcctccaagagcacctctgggggcacagcgcctggctgcct

SEQ ID NO: 456387 - DNA, 493 bp, Homo sapiens
  misc_feature: HEFZJCU01CKJ1Z.4.21.B10.1.454.heavy.3.raw
agcactgtagcacgaccggtgctcgatttagtgtcgtcgcaagagagggggggtcccttagactctcctgtgcagtctctggactcaacctcaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaaggcccatcggtcttcccctggcgccctgctccaggagcacctccgagagcacagcggccctgggctgcctggtcaaggactacttccctacagtgct

SEQ ID NO: 456388 - DNA, 495 bp, Homo sapiens; identical to SEQ ID NO: 452240
  misc_feature: HEFZJCU01ASJ60.4.19.B08.1.454.heavy.3.raw

SEQ ID NO: 456389 - DNA, 498 bp, Homo sapiens
  misc_feature: HEFZJCU01A9YYK.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtggggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaaggactacg

SEQ ID NO: 456390 - DNA, 501 bp, Homo sapiens
  misc_feature: HEFZJCU01BUNIP.22.86.H09.1.454.heavy.3.raw
  modified_base (497)..(497): a, c, t, g, unknown or other
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccctggcgccctnctcc

SEQ ID NO: 456391 - DNA, 485 bp, Homo sapiens
  misc_feature: HEFZJCU01BCSXR.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttccccctggccgccctgctccaggagcacctccgagagcacagcggccctgggctgcctggtcaagggactacttcctacgtgagct

SEQ ID NO: 456392 - DNA, 519 bp, Homo sapiens; identical to SEQ ID NO: 453755
  misc_feature: HEFZJCU01BIQY4.9.70.G04.1.454.heavy.3.raw

SEQ ID NO: 456393 - DNA, 518 bp, Homo sapiens; identical to SEQ ID NO: 444718
  misc_feature: HEFZJCU01ANQPR.9.34.D01.1.454.heavy.3.raw

SEQ ID NO: 456394 - DNA, 505 bp, Homo sapiens
  misc_feature: HEFZJCU01BKXST.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatcccggtgagcctacggcagcggcctttgactttctc

SEQ ID NO: 456395 - DNA, 533 bp, Homo sapiens
  misc_feature: HEFZJCU01ELCMG.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaagggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtaatggctgtgtttattggggccagggagccctggtcaccg

SEQ ID NO: 456396 - DNA, 518 bp, Homo sapiens; identical to SEQ ID NO: 444718
  misc_feature: HEFZJCU01DSAWZ.9.34.D01.1.454.heavy.3.raw

SEQ ID NO: 456397 - DNA, 548 bp, Homo sapiens; identical to SEQ ID NO: 453206
  misc_feature: HEFZJCU01BIMW7.48.3.A03.1.454.heavy.3.raw

SEQ ID NO: 456398 - DNA, 477 bp, Homo sapiens; identical to SEQ ID NO: 444659
  misc_feature: HEFZJCU01DT5EW.16.10.A10.1.454.heavy.3.raw

SEQ ID NO: 456399 - DNA, 522 bp, Homo sapiens
  misc_feature: HEFZJCU01DVWXF.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgaccctgggccagggaacccaggtcaccgtctcctcagcctccaccaagggcccatccgtcttccccctcggcgccctgctccaggagcacctccgagagcacagcggccctgggctgcctggtcaaggactacttcctaccg

SEQ ID NO: 456400 - DNA, 534 bp, Homo sapiens; identical to SEQ ID NO: 446321
  misc_feature: HEFZJCU01DYDR1.22.38.D05.1.454.heavy.3.raw

SEQ ID NO: 456401 - DNA, 318 bp, Homo sapiens
  misc_feature: HEFZJCU01BW1YG.14.28.C06.1.454.heavy.3.raw
cgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgtactaga

SEQ ID NO: 456402 - DNA, 517 bp, Homo sapiens
  misc_feature: HEFZJCU01DO2P0.2.11.A11.1.454.heavy.3.raw
acgctcgacacacgaccggtgctcgatttagctacgactgcagggtgtacacctgtggttctcggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggcctcgggggctactggggccagggaaccatggtcaccgtctcctcagcctccaccaagggcccatcggtcttcccctggcaccctcctccaagagcacctctgggggcacagcggccctgggctgcctggtcaggactacttcctgtcgagcgt

SEQ ID NO: 456403 - DNA, 524 bp, Homo sapiens; identical to SEQ ID NO: 445902
  misc_feature: HEFZJCU01DGNT3.9.78.H01.1.454.heavy.3.raw

SEQ ID NO: 456404 - DNA, 514 bp, Homo sapiens; identical to SEQ ID NO: 448164
  misc_feature: HEFZJCU01DJWBX.3.34.D01.1.454.heavy.3.raw

SEQ ID NO: 456405 - DNA, 510 bp, Homo sapiens
  misc_feature: HEFZJCU01DWBHI.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaaggggaccacggtcaccgtctcctcagcctccaccaagggcccatcc

SEQ ID NO: 456406 - DNA, 489 bp, Homo sapiens
  misc_feature: HEFZJCU01ENLLT.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggccatcggtcttcccctggcgcctgctccaggagcacctccgagagcacagcggccctgggctgcctggtcaaggactacttcccacgagagta

SEQ ID NO: 456407 - DNA, 492 bp, Homo sapiens
  misc_feature: HEFZJCU01DAB9P.40.33.C11.1.454.heavy.3.raw
tctagcgactcacgaccggtgctcgatttagagtgagctcgttgggtttggggaggcttagttcagcctggggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatctccagagacaacgccaagaacacagtgtctctgcaaatggacagtctgagagccgaggacacgggtgtctattattgtacaaaagtggggactaatgaatatggtgtggacgtctggggccaagggaccacggtcgtcgcctcttatgcctccaccaagggcccatcggtcttccccctggcgccctgctccaggagcacctccgagagcacagcggccctgggctgcctggtcaaggactacttccagtcgctacga

SEQ ID NO: 456408 - DNA, 491 bp, Homo sapiens
  misc_feature: HEFZJCU01BM6UN.19.53.E09.1.454.heavy.3.raw
tactctcgtgcacgaccggtgctcgatttagagagagtgtgttgagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggccctgggctgcctggtcaaggactacttcccacgagagta

SEQ ID NO: 456409 - DNA, 324 bp, Homo sapiens; identical to SEQ ID NO: 444475
  misc_feature: HEFZJCU01AS34D.18.17.B06.1.454.heavy.3.raw

SEQ ID NO: 456410 - DNA, 440 bp, Homo sapiens; identical to SEQ ID NO: 447689
  misc_feature: HEFZJCU01BYXOQ.48.20.B09.1.454.heavy.3.raw

SEQ ID NO: 456411 - DNA, 486 bp, Homo sapiens
  misc_feature: HEFZJCU01C9XKH.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctggggctctgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggagccaggggaccctggtcatcgtctccccagcctccaccaagggcccatcggtcttcccctggcgccctgctccaggagcacctccgagagcacagcggccctgggctgccctggtcaaggactacttcctacgtcgtat

SEQ ID NO: 456412 - DNA, 396 bp, Homo sapiens; identical to SEQ ID NO: 446071
  misc_feature: HEFZJCU01CWIL2.53.29.C07.1.454.heavy.3.raw

SEQ ID NO: 456413 - DNA, 519 bp, Homo sapiens
  misc_feature: HEFZJCU01CXTZ6.10.85.H08.1.454.heavy.3.raw
catagtagtgcacgaccggtgctcgatttagtatcactcagtcgcggggctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctagtggttcggacctctgggggccaggggtaaccc

SEQ ID NO: 456414 - DNA, 492 bp, Homo sapiens; identical to SEQ ID NO: 445919
  misc_feature: HEFZJCU01CVYXS.14.25.C03.1.454.heavy.3.raw

SEQ ID NO: 456415 - DNA, 504 bp, Homo sapiens
  misc_feature: HEFZJCU01DOAF7.47.38.D05.1.454.heavy.3.raw
agctcacgtacacgaccggtgctcgatttagtatctgatagttgggtttgggggagagcatcacccagcaaccacatctgtcctctaaagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgtacgttttgattggtctacg

SEQ ID NO: 456416 - DNA, 522 bp, Homo sapiens
  misc_feature: HEFZJCU01DZAJ1.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgaccctggggccagggaaccctggtcaccgtctcctcagcctccaccaaggcccatcggtcttcccctggcgccctgctccaggagcacctccgagagcacagcggcccgtgggccg

SEQ ID NO: 456417 - DNA, 523 bp, Homo sapiens; identical to SEQ ID NO: 451418
  misc_feature: HEFZJCU01AVW5U.12.40.D07.1.454.heavy.3.raw

SEQ ID NO: 456418 - DNA, 510 bp, Homo sapiens
  misc_feature: HEFZJCU01B4HGA.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattgggggagcgactggttcgacccctggggccagggaaccctggtcaccgtctcctcagcctccaccaagggcccatcggtcttcccctggcaccctcctccaagagcacctctgggggcacagcggccctgggctgcctggtcaaggactacttcctacgtcgtat

SEQ ID NO: 456419 - DNA, 528 bp, Homo sapiens
  misc_feature: HEFZJCU01AUJRH.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttccgaccccgtggggccagggaaccctggtcaccgtctcctcagcctccaccg

SEQ ID NO: 456420 - DNA, 511 bp, Homo sapiens
  misc_feature: HEFZJCU01EPRAA.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgattcaccatctccagagacaacgccaagaattcactgtatttgcaaatgaacagcctgagaggcgaggacacggccgtgtattatgtgcgcgagatgatagtagactctacagtagcaggtggta

SEQ ID NO: 456421 - DNA, 505 bp, Homo sapiens
  misc_feature: HEFZJCU01D5V0I.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtgggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtgacgtggtagttccgggggacacatgactaccg

SEQ ID NO: 456422 - DNA, 525 bp, Homo sapiens
  misc_feature: HEFZJCU01AS9T4.4.14.B03.1.454.heavy.3.raw
agcactgtagcacgaccggtgctcgatttagtgtgagtagttccgcgggggagagaggagccttagccctggattccaaggcctatccacttggtgatcagcactgagcaccgaggattcaccatggaactggggctccgctgggttttccttgttgctctttttggaggtgtccagtgtgaggtacaactggtggactctgggggaggcctggtcaggcctggggggtccctgagactctcctgtgcagcctctggattcaccttcggaaactatcacatgaactgggtccgccaggctccagggaaggggctggagtgggtctcctgtattagtagtgccggcacttacacatactatgcagactcagtgaagggccgattcaccatctccagagacaacgccaagaactcactgtttcttcaaatggacagcctcagagtcgacgacacggctgtgtattactgtgcgagagcggttagtggtggttacttccggggcaactggggccagggaaccctggtc

SEQ ID NO: 456423 - DNA, 385 bp, Homo sapiens
  misc_feature: HEFZJCU01CRMUH.11.61.F06.1.454.heavy.3.raw
cgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttccccctggcgccctgctccaggagcacctccgagagcacagcggccctgggctgcctggtcaaggactactttccgtatctctcg

SEQ ID NO: 456424 - DNA, 396 bp, Homo sapiens
  misc_feature: HEFZJCU01CK0GY.48.62.F07.1.454.heavy.3.raw
agtatacatacacgaccggtgctcgatttagtagtcgcataaagggaaaggggctggagtgggtctcatccattagtagtagcagtaattatatagacgacgcagactcagtgaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaaggcccatcggtcttccccctggcaccctcctccaagagcacctctgggggcacagcggccctgggctgcctggtcaaggactacttcctatgtatact

SEQ ID NO: 456425 - DNA, 492 bp, Homo sapiens
  misc_feature: HEFZJCU01BAQAZ.48.20.B09.1.454.heavy.3.raw
agtatacatacacgaccggtgctcgatttagtgtagtgtgaagggggagcacaattgaaaaagcccggggagtctctgaagatctcctgtgagggttctggatacagctttgccaactactggatcgcctgggtgcgccagatgcccgggaaaggcctggagtggatggggatcatctatcctggcgactctgataccagatacagcccgtccttccaaggccaagtcaccatctcagccgacaactccatcagcaccgcctacctgcagtggagcagcctgaaggcctcggacaccgccgtgtattactgtgcgagacatgattacggctactcacgtccgcactactggggccagggaaccctggtcaccgtctcctcagcttccaccaagggcccatcggtcttcccctggcgccctgctccaggagcacctcgtgggggcacagcggccctcgggctgcctggtcaaggactacttcctatgtatact

SEQ ID NO: 456426 - DNA, 498 bp, Homo sapiens; identical to SEQ ID NO: 445952
  misc_feature: HEFZJCU01BN80S.11.71.G05.1.454.heavy.3.raw

SEQ ID NO: 456427 - DNA, 518 bp, Homo sapiens
  misc_feature: HEFZJCU01DRN52.40.67.G01.1.454.heavy.3.raw
tctagcgactcacgaccggtgctcgatttagagtatacatattgggtttggggatgctttctgagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagttttccctgacgctgacgtctgtgaccgccgcagacacggctgtctattattgtgcgagactagccttctgtagtgggggtacttgcaacccgggatactactccacctttcggcttggacatctggggccgac

SEQ ID NO: 456428 - DNA, 505 bp, Homo sapiens
  misc_feature: HEFZJCU01BN5RA.3.20.B09.1.454.heavy.3.raw
agacgcactccacgaccggtgctcgatttagtgtagtgtgaagggacagggtctccgaaggcttcaccactcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgattatcttggggccaaggggacaa

SEQ ID NO: 456429 - DNA, 524 bp, Homo sapiens; identical to SEQ ID NO: 446153
  misc_feature: HEFZJCU01DF5NY.12.86.H09.1.454.heavy.3.raw

SEQ ID NO: 456430 - DNA, 522 bp, Homo sapiens
  misc_feature: HEFZJCU01BQ1UV.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttccccctggccaccctcctccaacgacgcacctctgggggcacagcggccctgggctgcctggtcaaggactacttcctagagacacg

SEQ ID NO: 456431 - DNA, 496 bp, Homo sapiens
  misc_feature: HEFZJCU01CXD0C.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcaggcggcctttgactttc

SEQ ID NO: 456432 - DNA, 396 bp, Homo sapiens; identical to SEQ ID NO: 444568
  misc_feature: HEFZJCU01EIKQP.47.46.E02.1.454.heavy.3.raw

SEQ ID NO: 456433 - DNA, 506 bp, Homo sapiens; identical to SEQ ID NO: 444696
  misc_feature: HEFZJCU01BCOKB.16.34.D01.1.454.heavy.3.raw

SEQ ID NO: 456434 - DNA, 519 bp, Homo sapiens; identical to SEQ ID NO: 446228
  misc_feature: HEFZJCU01D8EQ3.9.43.D10.1.454.heavy.3.raw

SEQ ID NO: 456435 - DNA, 533 bp, Homo sapiens
  misc_feature: HEFZJCU01EGR6Y.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggttgcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactactggggccagggaaccctggtcaccgtctcctcagcctccaccaaggg

SEQ ID NO: 456436 - DNA, 521 bp, Homo sapiens
  misc_feature: HEFZJCU01BOPVY.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactgggccagggcaccctggtcaccgtctcctcagcttccaccaagggcccatcggtcttcccccgtggcgccctgctccaggagcacctcgtgggggcacgagcggcccgtgggctgcctggtccaaggactaccttcccattaccg

SEQ ID NO: 456437 - DNA, 500 bp, Homo sapiens; identical to SEQ ID NO: 444529
  misc_feature: HEFZJCU01C2SSK.12.38.D05.1.454.heavy.3.raw

SEQ ID NO: 456438 - DNA, 477 bp, Homo sapiens; identical to SEQ ID NO: 444659
  misc_feature: HEFZJCU01CEPEW.16.10.A10.1.454.heavy.3.raw

SEQ ID NO: 456439 - DNA, 491 bp, Homo sapiens
  misc_feature: HEFZJCU01C4NLC.10.29.C07.1.454.heavy.3.raw
catagtagtgcacgaccggtgctcgatttagagtgctacgaagggaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggaatccccttcagtacctatggcatgcactgggtccgccaggctccaggcaaggggctggagtgggtggcagccatatcgtatgatgtaactaataaatactatgcagactccgtgaagggccgattcaccatctccagagacaatttcaagaacacgctgtttctgcaaatgaacagcctgagagctgaggacacggctgtgtattactgtgcgaaagatatcgcggtga

SEQ ID NO: 456440 - DNA, 539 bp, Homo sapiens
  misc_feature: HEFZJCU01DRZY7.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccggggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggccgtttcatgtctggggccaagggacgctggtcaccgtctcttcagcctccaccaagggcccatcggtcttcccctggcaccctcctccaagagcacctctgggggcacagcc

SEQ ID NO: 456441 - DNA, 429 bp, Homo sapiens; identical to SEQ ID NO: 447944
  misc_feature: HEFZJCU01DFKRH.4.37.D04.1.454.heavy.3.raw

SEQ ID NO: 456442 - DNA, 502 bp, Homo sapiens
  misc_feature: HEFZJCU01CVEHV.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggcctgggctgcctggtcaaggactacttccgagtagtaca

SEQ ID NO: 456443 - DNA, 519 bp, Homo sapiens
  misc_feature: HEFZJCU01CL4T0.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtaacctggtattc

SEQ ID NO: 456444 - DNA, 519 bp, Homo sapiens
  misc_feature: HEFZJCU01D6Y2J.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 456445 - DNA, 510 bp, Homo sapiens; identical to SEQ ID NO: 445542
  misc_feature: HEFZJCU01BI54K.16.21.B10.1.454.heavy.3.raw

SEQ ID NO: 456446 - DNA, 497 bp, Homo sapiens
  misc_feature: HEFZJCU01DP24J.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacggtccatcagcactgcctacatggagctgaccaggctgaaatttgaggacacggccatttattactgtgcaaggaacagcataatgactcgtccccgactttcg

SEQ ID NO: 456447 - DNA, 480 bp, Homo sapiens; identical to SEQ ID NO: 446171
  misc_feature: HEFZJCU01BG17C.22.36.D03.1.454.heavy.3.raw

SEQ ID NO: 456448 - DNA, 523 bp, Homo sapiens
  misc_feature: HEFZJCU01CY8RX.47.78.H01.1.454.heavy.3.raw
agctcacgtacacgaccggtgctcgatttagtgtgagtagtttgggtttggggagctctgggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttcctttcagtcaagtctggataagctgggtccgccaggctccagggatgggcctggagtggttggccgtgtcaagagcagaactgatggtgcgacatctgaatacgctgcacccgtgaaaggcagattcaccatctccagagatgattcaaataaatatgtcatatctaacaaatggaatagcctagaaatcgaggatacaggtgtttaattactgttcccacagggaatgcggttctctggggcccgaggga

SEQ ID NO: 456449 - DNA, 490 bp, Homo sapiens
  misc_feature: HEFZJCU01CRC4B.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactgggccagggaaccctggtcaccgtctcctcagcctccaccaagggcccatcggtcttcccctggcaccctcctccaagagcacctctgggggcacagcggccctgggctgcctggtcaaggactacttccgtatctctcg

SEQ ID NO: 456450 - DNA, 479 bp, Homo sapiens
  misc_feature: HEFZJCU01CPAFH.4.37.D04.1.454.heavy.3.raw
  modified_base (471)..(471): a, c, t, g, unknown or other
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctgacgacacggccgtatatttctntgcgaggg

SEQ ID NO: 456451 - DNA, 517 bp, Homo sapiens
  misc_feature: HEFZJCU01BPOW3.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttccccctggcaccctcctccaagagcacctctgggggcacagcggccctgggctgcctggtcaaggactacttcagacgtatca

SEQ ID NO: 456452 - DNA, 383 bp, Homo sapiens
  misc_feature: HEFZJCU01CTV8X.11.61.F06.1.454.heavy.3.raw
cgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctgggccaggggacaatggtaaccgtctcttcagcctccaccaagggcccatcggtcttccccctggcgccctgctccaggagcacctccgagagcacagcggccctggactgcctggtcaaggactacttccgtatctctcg

SEQ ID NO: 456453 - DNA, 539 bp, Homo sapiens
  misc_feature: HEFZJCU01ERT74.15.87.H10.1.454.heavy.3.raw
tctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaagaacttactgtatctgcaaatgaacagcctgagaggcgaggacacggctctgtattactgtgcgaggatacctcctctgggcgggccaggtttcctacggcatggacgtctggggccaagggaccacggtcaccgtctcctcagcctccaccaacgggcccatcggtcttcccctggcaccctcctccaagagcacctctgggggcacagcggccctgggctgcctggtcg

SEQ ID NO: 456454 - DNA, 418 bp, Homo sapiens; identical to SEQ ID NO: 446028
  misc_feature: HEFZJCU01D3C55.16.28.C06.1.454.heavy.3.raw

SEQ ID NO: 456455 - DNA, 473 bp, Homo sapiens
  misc_feature: HEFZJCU01D53EP.22.56.F01.1.454.heavy.3.raw
acatacgcgtcacgaccggtgctcgatttagcagacgtctgtcggggttctcattcaccactgcttcagtgggtgtgggctggatccgtcagcccccaggaaaggccctggagtggcttgcactcctttatggggatggcggtgaacactacagtccatctctgaagaccagactcaccatcgcccgggacacctccaagaaccaagtggtccttacactgaccagcatggaccctgtggacacaacaacatatttctgtgcacagagccgccagttagactgggggcctgtcgtggtggttggtgccgcaatgatgcatttcatatttggggccaagggacagtggtcaccgtctcggcagcctccaccaagggcccatcggtcttccccctggcgccctgctccaggaggcacctcccgagagcacagcggccctgggctgcctggtcaaggactacttccacgcgtatgt

SEQ ID NO: 456456 - DNA, 511 bp, Homo sapiens; identical to SEQ ID NO: 445840
  misc_feature: HEFZJCU01EFN25.11.13.B02.1.454.heavy.3.raw

SEQ ID NO: 456457 - DNA, 505 bp, Homo sapiens; identical to SEQ ID NO: 445664
  misc_feature: HEFZJCU01DFDXK.12.33.C11.1.454.heavy.3.raw

SEQ ID NO: 456458 - DNA, 468 bp, Homo sapiens
  misc_feature: HEFZJCU01DSMNX.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaagggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcggcctgggctgcctggtcaaggactacttccctacagtgct

SEQ ID NO: 456459 - DNA, 400 bp, Homo sapiens
  misc_feature: HEFZJCU01C5PYA.51.3.A03.1.454.heavy.3.raw
cgatcgtatacacgaccggtgctcgatttagagagcgtcacaggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaagctttgagtggatgggatggatcaccgctggcaatggtgacacaaaatattcacagaagttccagggcagagtcaccattaacagggacacatctgcgagtacaggctacatggaa

SEQ ID NO: 456460 - DNA, 498 bp, Homo sapiens
  misc_feature: HEFZJCU01BP6TD.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacgtggtttggggctacgtggggccaggggaaccctggtcaccgtctcctcagcctccaccg

SEQ ID NO: 456461 - DNA, 535 bp, Homo sapiens
  misc_feature: HEFZJCU01CEGPQ.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttcccctcggccaccctcctccaagagcacctctgggggcac

SEQ ID NO: 456462 - DNA, 509 bp, Homo sapiens
  misc_feature: HEFZJCU01EC0FQ.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccatatattactgtgcgaagcttagcggttaccggctacgattggggagcgactggttcgacccctgggaccagggaaccctggtcaccgtctcctcagcctccaccaagggcccatcggtcttcccctggcaccctcctccaagagcacctctgggggcacagcggccctgggctgcctggtcaaggactacttcctacgtcgtat

SEQ ID NO: 456463 - DNA, 400 bp, Homo sapiens; identical to SEQ ID NO: 444452
  misc_feature: HEFZJCU01C8WC1.47.24.C02.1.454.heavy.3.raw

SEQ ID NO: 456464 - DNA, 490 bp, Homo sapiens
  misc_feature: HEFZJCU01EQFWP.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgagggccgattcaccatctccagagacaattcccagaacacggtctatctgcacctgaccagcctgagaactgacgacacgtctctctactactgtgcgagagagttgacgagt

SEQ ID NO: 456465 - DNA, 518 bp, Homo sapiens
  misc_feature: HEFZJCU01D1CPU.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcaattcgtattggatgaattgggtccgccaggctccagggaaggggctggagtgggtggccaacataaagccagatggaggtgtaaaacagtatgtagactctgtggagggccggttcaccatctccggagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcgccctgctccaggagcacctccgagagcacagcggccctgggctgccg

SEQ ID NO: 456466 - DNA, 403 bp, Homo sapiens; identical to SEQ ID NO: 445029
  misc_feature: HEFZJCU01BUBKJ.10.77.G11.1.454.heavy.3.raw

SEQ ID NO: 456467 - DNA, 515 bp, Homo sapiens
  misc_feature: HEFZJCU01B2HHF.53.81.H04.1.454.heavy.3.raw
cgcgtatacacacgaccggtgctcgatttagtagtgtagattcgcggggggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaagggactggagtgggtggcagttatatcatttgatggaagcactacatactacgcaaactccgtgaagggccgattcaccatctccagagacgattccaggaacactctgtttctccaaatgaacagcctgagagctgaggacacggctctttattactgtgcgagagattctggatacagccattattacttgcccggctactggggccaggggaccctggtcaccgtctcctcagcctccaccaacgggcccatcggtcttcccctggccaccctcctccaagagcacctctgggggcac

SEQ ID NO: 456468 - DNA, 526 bp, Homo sapiens
  misc_feature: HEFZJCU01DBPUN.3.55.E11.1.454.heavy.3.raw
agacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgatggaagaaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaaccttccagactactggggccagggaaccctggtcaccgtctcctcagcctccaccaagggcccatcggtcttccccctggcacccctcctcccaagacg

SEQ ID NO: 456469 - DNA, 422 bp, Homo sapiens; identical to SEQ ID NO: 444681
  misc_feature: HEFZJCU01A815L.16.78.H01.1.454.heavy.3.raw

SEQ ID NO: 456470 - DNA, 392 bp, Homo sapiens
  misc_feature: HEFZJCU01C8DDM.51.13.B02.1.454.heavy.3.raw
cgatcgtatacacgaccggtgctcgatttagtctagcgactagcaacacacaaagggggggaaatcagtcgtagtggagagaccttctacaacccgtccctcaagagtcgagtcgccatatcaacagacgcgtccaagagtgaggtgtccctgacactcaggtctgtgaccgccgcggacgcggctgtatactactgtgcgagagtccccgctgggttttggagtggttattatgccggtatggacgtctggggcgcagggaccacggtcgccgtctcttcagcctccaccaagggcccatcggtcttccccctggcaccctcctccaagagcacctctgggggcacagcggccctgggctgcctggtcaaggactacttcctcgtagcact

SEQ ID NO: 456471 - DNA, 539 bp, Homo sapiens
  misc_feature: HEFZJCU01EHIJN.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggttggatcggggagtttggttcctggggccagggaaccctggtc

SEQ ID NO: 456472 - DNA, 505 bp, Homo sapiens
  misc_feature: HEFZJCU01CYA3Z.53.85.H08.1.454.heavy.3.raw
cgcgtatacacacgaccggtgctcgatttagtatcactcagtcgcgggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcggggggacgcgtggtccagcctgggaggtccctgagactctcctgtgtagcctctggatttaccttcagggtctatgacatgcactgggtccgccaggctccaggcaaggggctggagtgggtggcacttatctcacatgatggaaataaaaaactatggtgactccgtgaagggccgattctccgtctccagagacaattccaagaacaccttgtatctgcaaatgaacagcctgagatatgaggacacggctctgtattactgtgcgaagaaaaggttactagtggaagagtgggagtt

SEQ ID NO: 456473 - DNA, 510 bp, Homo sapiens
  misc_feature: HEFZJCU01AI94H.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctgggggcacagcggccctggctgcctggtcaaggactacttcccata

SEQ ID NO: 456474 - DNA, 531 bp, Homo sapiens
  misc_feature: HEFZJCU01C7ULA.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatccctgaaagcgtcaactactactactacggtatggacctcg

SEQ ID NO: 456475 - DNA, 477 bp, Homo sapiens
  misc_feature: HEFZJCU01BWAQU.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccc

SEQ ID NO: 456476 - DNA, 514 bp, Homo sapiens
  misc_feature: HEFZJCU01BLFNE.49.87.H10.1.454.heavy.3.raw
agtcgagagacacgaccggtgctcgatttagcagtactgcgttgggtttggggcgtgggagaggagcccagcactgggattccgaggtgtttccattcagtgatctgcactgaacacagaggactcgccatggagtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatccccgggtatagcagtgtctggtacatattactc

SEQ ID NO: 456477 - DNA, 496 bp, Homo sapiens
  misc_feature: HEFZJCU01ES97E.22.11.A11.1.454.heavy.3.raw
acatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagcgtggtggagactgggacggagccttgatccagcctggggggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccgcgggggtc

SEQ ID NO: 456478 - DNA, 504 bp, Homo sapiens
  misc_feature: HEFZJCU01D97QR.47.23.C01.1.454.heavy.3.raw
agctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggcccccggacagagacctgagtggatgggatggatcagcattggcaatggtaacataaaacactcacagaagttccagggcagggtcaccattaccagagacatctccgcgaccacagcctacatggaactgagcagcctgacttctgaagacacggctatttactactgtgcgagagaggggtttgactggaacttccttctacatggacgtctggggcaaaggga

SEQ ID NO: 456479 - DNA, 510 bp, Homo sapiens
  misc_feature: HEFZJCU01ADY9N.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagtactccgtgaagggccgattcaccgtctccagagacaattccaggcacacgctgtatctgcaaatgaacagcctgagagctgaggacacggctgtgtattactgtgcgaaagatttctatagaggtgacgtacgggggcgttcg

SEQ ID NO: 456480 - DNA, 379 bp, Homo sapiens; identical to SEQ ID NO: 444450
  misc_feature: HEFZJCU01EDZI0.47.77.G11.1.454.heavy.3.raw

SEQ ID NO: 456481 - DNA, 422 bp, Homo sapiens; identical to SEQ ID NO: 444681
  misc_feature: HEFZJCU01BB18A.16.78.H01.1.454.heavy.3.raw

SEQ ID NO: 456482 - DNA, 518 bp, Homo sapiens; identical to SEQ ID NO: 444718
  misc_feature: HEFZJCU01AH8NG.9.34.D01.1.454.heavy.3.raw

SEQ ID NO: 456483 - DNA, 507 bp, Homo sapiens
  misc_feature: HEFZJCU01BRL7P.48.59.F04.1.454.heavy.3.raw
agtatacatacacgaccggtgctcgatttagtacacacacttagggattggggcagggtgtacacctgtggttctcggggctgccctttggctttggagatggttttctcgatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccg

SEQ ID NO: 456484 - DNA, 411 bp, Homo sapiens; identical to SEQ ID NO: 454934
  misc_feature: HEFZJCU01CYNJ7.51.60.F05.1.454.heavy.3.raw

SEQ ID NO: 456485 - DNA, 484 bp, Homo sapiens; identical to SEQ ID NO: 446564
  misc_feature: HEFZJCU01CMHWB.19.13.B02.1.454.heavy.3.raw

SEQ ID NO: 456486 - DNA, 390 bp, Homo sapiens
  misc_feature: HEFZJCU01ARZM5.16.24.C02.1.454.heavy.3.raw
tgtactactccacgaccggtgctcgatttagtacagatcgttagggaaaggggctggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctggcgccctgctccaggagcacctccgagagcacagcggcctgggctgcctggtcaaggactacttccgagtagtaca

SEQ ID NO: 456487 - DNA, 516 bp, Homo sapiens
  misc_feature: HEFZJCU01B03IV.8.34.D01.1.454.heavy.3.raw
ctcgcgtgtccacgaccggtgctcgatttagatcgtctgtgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaagggagggggaaccagcgggagtccaagtactctt

SEQ ID NO: 456488 - DNA, 505 bp, Homo sapiens
  misc_feature: HEFZJCU01A7APB.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggccctgggctgcctggtcaaggactacttcccactacct

SEQ ID NO: 456489 - DNA, 501 bp, Homo sapiens
  misc_feature: HEFZJCU01ATFOS.9.30.C08.1.454.heavy.3.raw
tgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcagcctccaccaagggcccatcggtcttccccctggcgccctgctccaggagcacctctgggggcacagcggccctgggctgcctggtcaaggactacttccagacgtatca

SEQ ID NO: 456490 - DNA, 503 bp, Homo sapiens
  misc_feature: HEFZJCU01CD7A6.48.53.E09.1.454.heavy.3.raw
agtatacatacacgaccggtgctcgatttagagagagtgtgttgggtttgggggcttttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggccaagggacaatggtcaccgt

SEQ ID NO: 456491 - DNA, 504 bp, Homo sapiens
  misc_feature: HEFZJCU01EH9UD.14.71.G05.1.454.heavy.3.raw
cgtctagtaccacgaccggtgctcgatttagtgtcgtcgcaagagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaagggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagattttggagttggttattatacctttgacttc

SEQ ID NO: 456492 - DNA, 501 bp, Homo sapiens; identical to SEQ ID NO: 450034
  misc_feature: HEFZJCU01CKP91.12.38.D05.1.454.heavy.3.raw

SEQ ID NO: 456493 - DNA, 498 bp, Homo sapiens
  misc_feature: HEFZJCU01BX3XO.53.58.F03.1.454.heavy.3.raw
cgcgtatacacacgaccggtgctcgatttagtctgatcgagaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctgggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgcaaggaacagcataatgactcgtcccccggactttacg

SEQ ID NO: 456494 - DNA, 313 bp, Homo sapiens; identical to SEQ ID NO: 444518
  misc_feature: HEFZJCU01EA564.7.10.A10.1.454.heavy.3.raw

SEQ ID NO: 456495 - DNA, 517 bp, Homo sapiens
  misc_feature: HEFZJCU01DDIOZ.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaaggaggcatatgggaagtacgattttcgatccctcgcagtcgacactttgattactggggccggggaaccctggtcgccgtctcctcagcctccaccaagggcccatcggtcttccccctggcaccctcctccaagagcacctctgggggcacagcggcctggctgcctggtcaaggactacttccagacgtatca

SEQ ID NO: 456496 - DNA, 508 bp, Homo sapiens
  misc_feature: HEFZJCU01D3IDU.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggcttttcttgtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaaggggccggagtgggtgtcagtcattagtagtagtggtgatagaatttaccacacagactccgtgaagggccgcttcaccatctctagagacaattcccagaacacactgtatctgcaaatgactaggctgagagccgacgacacggccatttattactgcgcgaaggatatacgggtcgacaacggtggctacgcgttt

SEQ ID NO: 456497 - DNA, 519 bp, Homo sapiens
  misc_feature: HEFZJCU01EOFI4.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagcgtggtttccttgttaggttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtattc

SEQ ID NO: 456498 - DNA, 398 bp, Homo sapiens
  misc_feature: HEFZJCU01BBJIB.47.46.E02.1.454.heavy.3.raw
agctcacgtacacgaccggtgctcgatttagactcatctacagggaaaggggcgtggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtggcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 456499 - DNA, 510 bp, Homo sapiens
  misc_feature: HEFZJCU01B1B2T.40.12.B01.1.454.heavy.3.raw
tctagcgactcacgaccggtgctcgatttagtagtgtagattccgcggggagctctgggagaggagccccagccctgagattcccaggtgtttccattcagtgatcagcactgaacacagaggactcaccatggagttgggactgagctggattttccttttggctattttaaaaggtgtccagtgtgaagtgcaactggtggagtctgggggagacttggtacagcctggcaggtccctgagactctcctgtacagcctctggattcacctttggtgattatgccatgcactgggtccggcaagctccagggaagggcctggagtgggtctcaggtatgaattggaacagtgctagtatcggctatgcggactctgtgaggggccggttcaccatctccagagacagcgccaagagttccctgtacctgcaatgaacagtctgagaattgaggacacggccttgtattattgtgcgaagggactatggttcggggagggccttccacta

SEQ ID NO: 456500 - DNA, 489 bp, Homo sapiens; identical to SEQ ID NO: 444591
  misc_feature: HEFZJCU01EQJEU.18.70.G04.1.454.heavy.3.raw

SEQ ID NO: 456501 - DNA, 507 bp, Homo sapiens
  misc_feature: HEFZJCU01AJ70Q.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctgggggggctggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggcccgattcaccatctccagagacaattccaagaacacgatgtatctgcaaatggacagcctaagagttgaggacacggctgtttattactgtacgaaagaggggggatacgagtggcagctccaagtacttac

SEQ ID NO: 456502 - DNA, 497 bp, Homo sapiens
  misc_feature: HEFZJCU01AL1YV.51.78.H01.1.454.heavy.3.raw
cgatcgtatacacgaccggtgctcgatttagtgtgagtagtttgggtttgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggccaccctcctccaagagcacctctgggggcacagcggccctggctgcctggtcaaggactacttcctcgtagcact

SEQ ID NO: 456503 - DNA, 512 bp, Homo sapiens
  misc_feature: HEFZJCU01A6V1O.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagccggccctggg

SEQ ID NO: 456504 - DNA, 519 bp, Homo sapiens
  misc_feature: HEFZJCU01D5DC2.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaacgggcccattcc

SEQ ID NO: 456505 - DNA, 437 bp, Homo sapiens; identical to SEQ ID NO: 447018
  misc_feature: HEFZJCU01BVG9L.40.27.C05.1.454.heavy.3.raw

SEQ ID NO: 456506 - DNA, 504 bp, Homo sapiens
  misc_feature: HEFZJCU01CYRIJ.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccactcggtcttcccctggcaccctcctccagagcacctctgggggcacagcggccctgggctgcctggtcaggactacttcctacgtcgtat

SEQ ID NO: 456507 - DNA, 497 bp, Homo sapiens
  misc_feature: HEFZJCU01EJ03W.12.14.B03.1.454.heavy.3.raw
atacgacgtacacgaccggtgctcgatttagtgtgagtagttccgcggggggggaggcttggttcggcctggcgggtccctgagactctcctgcgcagcctctggattcctttttgaggatttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaaggggctctggttcagggatggggctttgactcctgggcccagggaaccctggtcgcggtctcctcagcctccaccaagggcccatcggtcttccccctggcaccctcctccaagagcacctctgggggcacagcggccctgggctgcctggtcaaggactacttcctacgtcgtat

SEQ ID NO: 456508 - DNA, 488 bp, Homo sapiens
  misc_feature: HEFZJCU01BVUEZ.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaaggcccatcggtcttccccctggcgccctgctccaggagcacctccgagagcacagcggccctgggctgcctggtcaggactacttcccatactcgta

SEQ ID NO: 456509 - DNA, 500 bp, Homo sapiens; identical to SEQ ID NO: 445720
  misc_feature: HEFZJCU01ET1I2.3.20.B09.1.454.heavy.3.raw

SEQ ID NO: 456510 - DNA, 500 bp, Homo sapiens
  misc_feature: HEFZJCU01BBWGP.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtgacccctgactgataaaccggactggttcgacccctcggggccagggaaccctggtcaccgtctcct

SEQ ID NO: 456511 - DNA, 506 bp, Homo sapiens
  misc_feature: HEFZJCU01CURPJ.52.53.E09.1.454.heavy.3.raw
cgcagtacgacacgaccggtgctcgatttagagagagtgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctgggctgcctggtcaaggactacttcctatacgatcg

SEQ ID NO: 456512 - DNA, 515 bp, Homo sapiens
  misc_feature: HEFZJCU01BFRHA.22.34.D01.1.454.heavy.3.raw
acatacgcgtcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcagtcgacactttgattactgggccggggaaccctggtcgccgtctcctcagcctccaccaagggcccatcggtcttcccctggcaccctcctccaagagcacctctgggggcacagcggccctggctgcctggtcaaggactacttccagacgtatca

SEQ ID NO: 456513 - DNA, 513 bp, Homo sapiens
  misc_feature: HEFZJCU01DI8EH.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattacgtggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatacctactttgactactggggaccg

SEQ ID NO: 456514 - DNA, 517 bp, Homo sapiens
  misc_feature: HEFZJCU01CHIA3.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactgggggccaggggaagcttggtcaccgtctcctc

SEQ ID NO: 456515 - DNA, 511 bp, Homo sapiens
  misc_feature: HEFZJCU01CZPJH.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctcgcagcctccaccaaggccc

SEQ ID NO: 456516 - DNA, 478 bp, Homo sapiens
  misc_feature: HEFZJCU01CXQVH.12.75.G09.1.454.heavy.3.raw
atacgacgtacacgaccggtgctcgatttagtatagacatcagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcgacgggcccctcccac

SEQ ID NO: 456517 - DNA, 387 bp, Homo sapiens; identical to SEQ ID NO: 445229
  misc_feature: HEFZJCU01CS2HO.11.20.B09.1.454.heavy.3.raw

SEQ ID NO: 456518 - DNA, 491 bp, Homo sapiens; identical to SEQ ID NO: 445531
  misc_feature: HEFZJCU01CQYSQ.11.38.D05.1.454.heavy.3.raw

SEQ ID NO: 456519 - DNA, 519 bp, Homo sapiens
  misc_feature: HEFZJCU01CQ85P.49.60.F05.1.454.heavy.3.raw
agtcgagagacacgaccggtgctcgatttagtacgtcatcagggaaaggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcagtagtaattactactggggctgggtccgccagcccccagggaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtcgtggggccaagggaccacggtcaccgtctcctcagcct

SEQ ID NO: 456520 - DNA, 511 bp, Homo sapiens; identical to SEQ ID NO: 446675
  misc_feature: HEFZJCU01BCNXC.4.23.C01.1.454.heavy.3.raw

SEQ ID NO: 456521 - DNA, 489 bp, Homo sapiens; identical to SEQ ID NO: 444791
  misc_feature: HEFZJCU01C2QF4.47.85.H08.1.454.heavy.3.raw

SEQ ID NO: 456522 - DNA, 482 bp, Homo sapiens
  misc_feature: HEFZJCU01CHSE3.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctgggccaagggaccacggtcatcgtctcctcagcctccaccaagggcccatcggtcttcccctggcaccctcctccaagagcacctctgggggcacagcggccctgggctgcctggtcaaggactacttccgtatctctcg

SEQ ID NO: 456523 - DNA, 387 bp, Homo sapiens; identical to SEQ ID NO: 445229
  misc_feature: HEFZJCU01D7EQD.11.20.B09.1.454.heavy.3.raw

SEQ ID NO: 456524 - DNA, 521 bp, Homo sapiens
  misc_feature: HEFZJCU01BQIZ6.4.1.A01.1.454.heavy.3.raw
agcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcattaactatgctatccattgggtgcgccaggcccccggacaaaacctgacgtggatgggttggatcaatggtgaaactggaaaaaccaaatattcaccgagcttccagggcagaatgaccatctcccgggacacatccgcgagcgcaatctatctggaactgagccgcctgacatctgcagactcggcagtatatttctgtgcgagagagggggaggatgggttgaggggaatttggttattccattactacttttgacccactgggggcccaggggtaa

SEQ ID NO: 456525 - DNA, 504 bp, Homo sapiens
  misc_feature: HEFZJCU01B7KDX.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgatacggccgtctattactgtgcgagagtcccacgatccggtgagcctacggcagcggcctttgacttcgtc

SEQ ID NO: 456526 - DNA, 499 bp, Homo sapiens
  misc_feature: HEFZJCU01DSYDX.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagagcacagcggcctgggctgcctggtcaaggactacttcctacgtcgtat

SEQ ID NO: 456527 - DNA, 483 bp, Homo sapiens; identical to SEQ ID NO: 444532
  misc_feature: HEFZJCU01EZKD8.47.59.F04.1.454.heavy.3.raw

SEQ ID NO: 456528 - DNA, 385 bp, Homo sapiens
  misc_feature: HEFZJCU01ECV2V.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaacgagttctccctggacttgacctctgtgaccgccgcagacacggctgtttattactgtgcgagacgactacctgactccaatccatactttgactattggggccggggagccctggtcaccgtctccccaccctccaccaagggcccatcggtcttccccctggcaccctcctccaagagcacctctgggggcacagcggccctgggctgcctggtcaaggattacttcccatactcgta

SEQ ID NO: 456529 - DNA, 529 bp, Homo sapiens
  misc_feature: HEFZJCU01CNJDB.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgccctgctccaggagcacctccgacgagcacagcggccctggggccg

SEQ ID NO: 456530 - DNA, 454 bp, Homo sapiens
  misc_feature: HEFZJCU01BMLW5.52.78.H01.1.454.heavy.3.raw
cgcagtacgacacgaccggtgctcgatttagtgtgagtagtttgggtttggggggaagaggaagactgacggtccccccaggagttcaggtgctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttccccctggcaccctcctccaagagcacctctgggggcacagcggccctgggctgcctggtcaaggactacttcctatacgatcg

SEQ ID NO: 456531 - DNA, 509 bp, Homo sapiens
  misc_feature: HEFZJCU01B0699.12.30.C08.1.454.heavy.3.raw
atacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtcccccagggaagggcctggagtggattggggtacatctatcacagtgggagcacctactacattccgtccctgaagagtcgaattacgatgtcagtaaacacgtctaggaaccagttctccctgaagctgaggtctgtgactgccgcagacacggccgtctactactgtgccaggtgggctttgcgccagtggttcagagatgatcgcttcgattcgtggggccagggaattcg

SEQ ID NO: 456532 - DNA, 496 bp, Homo sapiens
  misc_feature: HEFZJCU01DAHYB.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccatgagcacctctgggggcacagcggccctgggctgcctggtcaaggactacttccgagtagtaca

SEQ ID NO: 456533 - DNA, 508 bp, Homo sapiens; identical to SEQ ID NO: 445594
  misc_feature: HEFZJCU01AMO9B.17.25.C03.1.454.heavy.3.raw

SEQ ID NO: 456534 - DNA, 520 bp, Homo sapiens
  misc_feature: HEFZJCU01AYPO8.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcagggagttcgactacgtgggggccacggggaaccctggtcaccgtctcctcagcctccacc

SEQ ID NO: 456535 - DNA, 520 bp, Homo sapiens
  misc_feature: HEFZJCU01D5Q7H.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatccggtcttccccctggcaccctcctccaagagcacctctgggggcacagcggccctgggctgcctggtcaaggactacttccagacgtatca

SEQ ID NO: 456536 - DNA, 532 bp, Homo sapiens
  misc_feature: HEFZJCU01D1YHY.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacggtatggacctctggg

SEQ ID NO: 456537 - DNA, 509 bp, Homo sapiens
  misc_feature: HEFZJCU01AH1A7.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtc

SEQ ID NO: 456538 - DNA, 523 bp, Homo sapiens
  misc_feature: HEFZJCU01BC0GC.3.82.H05.1.454.heavy.3.raw
agacgcactccacgaccggtgctcgatttagtcgagctctctcgcgggggggagaggagaccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaagggctggagtgggtctcagttatttacaattctggtaccacatactactccgacccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctggggccgtc

SEQ ID NO: 456539 - DNA, 377 bp, Homo sapiens; identical to SEQ ID NO: 444596
  misc_feature: HEFZJCU01CU9Z1.47.77.G11.1.454.heavy.3.raw

SEQ ID NO: 456540 - DNA, 498 bp, Homo sapiens
  misc_feature: HEFZJCU01B81VG.43.78.H01.1.454.heavy.3.raw
tgtgagtagtcacgaccggtgctcgatttagtgtgagtagtttgggtttggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgccttgatatgtggggccaaggacaatgtc

SEQ ID NO: 456541 - DNA, 515 bp, Homo sapiens
  misc_feature: HEFZJCU01B9209.26.12.B01.1.454.heavy.3.raw
agactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccagggaggggcctggagtgggtctcaggtatcagttacaatagtggtaatatactctatgcggactctgtgaagggccgattcaccatctccagagacaacgccaggaactccctctatctagaaatggacagtctgacaactgaggacacggccttttatttctgtgcaaaggtggaaccgacatatttcacaagctggcactggtacttcg

SEQ ID NO: 456542 - DNA, 501 bp, Homo sapiens
  misc_feature: HEFZJCU01EBGON.26.23.C01.1.454.heavy.3.raw
agactatactcacgaccggtgctcgatttagtacacgtgattagggattgggaggcgtggtccagcctgggggctccctgagactctcctgtacaacgtctggattcaacttcaattattatgttctacactgggtccgccaggctccaggcaaggggctggagtgggtggcaggtatgccacatgatggattcagtagatactacatagactccgtgaagggccgatcgaccatctccagagacgtttccgagaacacattaaatctggaaataaacttcgtgagaagtgacgactcggccgtttatttttgtgcgagagaggggtacagtagcggccgagctccggcctttgaccactggggccagggaaccctggtcaccgtctcctcagcctccaccaagggcccatcggtcttcccctggcgccctgctccaggagcacctccgagagcacagcggccctgggctgcctggtcaaggactacttccagtatagtct

SEQ ID NO: 456543 - DNA, 505 bp, Homo sapiens
  misc_feature: HEFZJCU01CPQOI.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcgaggccctatcctacagtgaccactccacgctggttcacctctggggccac

SEQ ID NO: 456544 - DNA, 506 bp, Homo sapiens
  misc_feature: HEFZJCU01A3DT4.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggtatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgtttctgtcatcgtacaatttgataggctctatggactggacttctggggccg

SEQ ID NO: 456545 - DNA, 526 bp, Homo sapiens; identical to SEQ ID NO: 447476
  misc_feature: HEFZJCU01CL3MM.14.55.E11.1.454.heavy.3.raw

SEQ ID NO: 456546 - DNA, 491 bp, Homo sapiens; identical to SEQ ID NO: 445333
  misc_feature: HEFZJCU01EK7AM.19.53.E09.1.454.heavy.3.raw

SEQ ID NO: 456547 - DNA, 479 bp, Homo sapiens
  misc_feature: HEFZJCU01BRHVQ.4.37.D04.1.454.heavy.3.raw
  modified_base (424)..(424): a, c, t, g, unknown or other
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctanatggacctgagcggcctgacatctgacgacacggccgtatatttctgtgcgaggg

SEQ ID NO: 456548 - DNA, 523 bp, Homo sapiens
  misc_feature: HEFZJCU01EFXV2.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccgagcgggagttccaagtactcctttgacgtctc

SEQ ID NO: 456549 - DNA, 480 bp, Homo sapiens
  misc_feature: HEFZJCU01CB4J1.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggcatcgtctcctcagcctccaccaaggcccatcggtctcccctgcgcctgctccaggagcacctccgagagcacagcggcctggctgcctggtcaaggactacttcctacgtgagct

SEQ ID NO: 456550 - DNA, 510 bp, Homo sapiens
  misc_feature: HEFZJCU01B3G8Y.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctcagagcacctctggggcacagcgccg

SEQ ID NO: 456551 - DNA, 526 bp, Homo sapiens
  misc_feature: HEFZJCU01D6RM8.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctgggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatgggggcccacgaacgttactacgctatggacgtctggggccaagggaccac

SEQ ID NO: 456552 - DNA, 484 bp, Homo sapiens; identical to SEQ ID NO: 451109
  misc_feature: HEFZJCU01DXKF1.51.78.H01.1.454.heavy.3.raw

SEQ ID NO: 456553 - DNA, 385 bp, Homo sapiens
  misc_feature: HEFZJCU01BWGC5.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaaacgagttctccctggacttgacctctgtgaccgccgcagacacggctgtttattactgtgcgagacgactacctgactccaatccatactttgactattggggccgggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 456554 - DNA, 529 bp, Homo sapiens; identical to SEQ ID NO: 454216
  misc_feature: HEFZJCU01ACXSX.49.27.C05.1.454.heavy.3.raw

SEQ ID NO: 456555 - DNA, 527 bp, Homo sapiens
  misc_feature: HEFZJCU01DGQAO.40.70.G04.1.454.heavy.3.raw
tctagcgactcacgaccggtgctcgatttagtgtagtgtgaagggaaagggggctttctgagagtcatggatctcatgtgcaagaaaatgaagcacctgtggtccttcctcctgctggtggcggctcccagatgggtcctgtcccagctgcagctgcaggagtcgggcccaggactggtgaagccttcggagaccctgtccctcacctgcactgtctctggtgcctccatcagcagtactagttactactggggctggatccgccagtccccagggaagggactggagtggattgcggctatttcttatagtgagaacacctactacaacccgtccctcaagagtcgagtcaccatatccgtagacacgtccaacaaccagttctccctgaacctgagccctgtgaccgtcgcagacacggctgtatattattgtgggagacgctttcgtgacttaggccctgactacggtggcccccataccgaggacgatttcctcggtatggacgtctggggccgaagggaccg

SEQ ID NO: 456556 - DNA, 492 bp, Homo sapiens; identical to SEQ ID NO: 449507
  misc_feature: HEFZJCU01BDTK1.11.26.C04.1.454.heavy.3.raw

SEQ ID NO: 456557 - DNA, 528 bp, Homo sapiens
  misc_feature: HEFZJCU01CFTGX.48.25.C03.1.454.heavy.3.raw
agtatacatacacgaccggtgctcgatttagtagtgtagatttgggtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatagttactttgacaaactggggccagggaaccctggtcaccgtctcctcagcctccaccaagggcccatcggtcttcccctggcgccctgctccaggagcacctccg

SEQ ID NO: 456558 - DNA, 432 bp, Homo sapiens; identical to SEQ ID NO: 444920
  misc_feature: HEFZJCU01AKEJI.11.39.D06.1.454.heavy.3.raw

SEQ ID NO: 456559 - DNA, 500 bp, Homo sapiens; identical to SEQ ID NO: 447911
  misc_feature: HEFZJCU01DE39T.26.23.C01.1.454.heavy.3.raw

SEQ ID NO: 456560 - DNA, 484 bp, Homo sapiens
  misc_feature: HEFZJCU01C43L1.48.35.D02.1.454.heavy.3.raw
agtatacatacacgaccggtgctcgatttagcacacgatagttgggtttgggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataagat

SEQ ID NO: 456561 - DNA, 324 bp, Homo sapiens; identical to SEQ ID NO: 444475
  misc_feature: HEFZJCU01DSZ5I.18.17.B06.1.454.heavy.3.raw

SEQ ID NO: 456562 - DNA, 518 bp, Homo sapiens
  misc_feature: HEFZJCU01D6BCN.22.28.C06.1.454.heavy.3.raw
  modified_base (505)..(505): a, c, t, g, unknown or other
acatacgcgtcacgaccggtgctcgatttagagctcacgtattgggtttggggaagtagtccttgaccaggcagctcccagatgggtcctgtcccaggtgcacctgcaggagtcgggcccaggactggtgaagccttcggagaccctgtccctcacctgcattgtctccggtggctccatcagtgattactactggacctggatccggcagtccccagggcagggactggaatggattggatatttccatacgactgcgatgaccaactgcaacccctcctcagggctcgagtcagcctgtcagtagacacgtccaagaaccagacttccctgagactgacctctgtgaccgccgcagacacggccgtgtatttctgtgtcggtacgagtgtccatgacagtcacaaacaactggtctcctgggccagggaaccctggtcaccgtctcctcacgcctccaccaagggcccatcggtcttcccctggcaccctcctccaagacgcncctcgtggggcac

SEQ ID NO: 456563 - DNA, 543 bp, Homo sapiens
  misc_feature: HEFZJCU01DYZEQ.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggctggatcggggagtttgggttcctggggccacggggaaccctggtcc

SEQ ID NO: 456564 - DNA, 489 bp, Homo sapiens
  misc_feature: HEFZJCU01CJFLV.51.55.E11.1.454.heavy.3.raw
cgatcgtatacacgaccggtgctcgatttagcactcgcacgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctctttttactgtgcgccaggaagca

SEQ ID NO: 456565 - DNA, 399 bp, Homo sapiens
  misc_feature: HEFZJCU01CWDET.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaaggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 456566 - DNA, 492 bp, Homo sapiens
  misc_feature: HEFZJCU01AI003.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcagcctccaccaagggcccatcggtcttcccctggcgccctgctccaggagcaccctccgagagcacagccggccctgggctcgcctggtcaaggactacttcccatactcgta

SEQ ID NO: 456567 - DNA, 467 bp, Homo sapiens; identical to SEQ ID NO: 448623
  misc_feature: HEFZJCU01CKV4S.48.59.F04.1.454.heavy.3.raw

SEQ ID NO: 456568 - DNA, 501 bp, Homo sapiens
  misc_feature: HEFZJCU01EPTGF.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtacg

SEQ ID NO: 456569 - DNA, 500 bp, Homo sapiens; identical to SEQ ID NO: 445028
  misc_feature: HEFZJCU01EYG5R.13.12.B01.1.454.heavy.3.raw

SEQ ID NO: 456570 - DNA, 461 bp, Homo sapiens; identical to SEQ ID NO: 454373
  misc_feature: HEFZJCU01BVL5I.4.82.H05.1.454.heavy.3.raw

SEQ ID NO: 456571 - DNA, 514 bp, Homo sapiens
  misc_feature: HEFZJCU01B6VTB.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatggggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatacctactttgactactggggccaac

SEQ ID NO: 456572 - DNA, 437 bp, Homo sapiens; identical to SEQ ID NO: 444603
  misc_feature: HEFZJCU01A7142.3.21.B10.1.454.heavy.3.raw

SEQ ID NO: 456573 - DNA, 518 bp, Homo sapiens
  misc_feature: HEFZJCU01EMJ3H.48.5.A05.1.454.heavy.3.raw
agtatacatacacgaccggtgctcgatttagatagatagacagggggctctgagagaggagcccagccctgggattttcaggtgttttcatttggtgatcaggactgaacagagagaactcaccatggagtttgggttgagctggctttttcttgtggctattttaaaaggtgtccagtgtgaggtgcagctgttggagtctgggggaggcttggtacagccgggggggtccctgagactctcctgtgcaacctctggattcacctttaggggctatgccatgaactgggtccgccaggttcctgggaaggggctggagtgggtctcgatctattagtgagactggtgatactacagactacgcagactccgtgacggggccggttcaccgtctccagagacaattccaagacacgctattctgcaaatgaacagcctgagagtcgacgacacggccgtatactactgtgcgagacagatgctgccgctgtccgtgggccacgggaccctggcaccgt

SEQ ID NO: 456574 - DNA, 505 bp, Homo sapiens; identical to SEQ ID NO: 445122
  misc_feature: HEFZJCU01APQZG.49.31.C09.1.454.heavy.3.raw

SEQ ID NO: 456575 - DNA, 400 bp, Homo sapiens; identical to SEQ ID NO: 444452
  misc_feature: HEFZJCU01C4NWM.47.24.C02.1.454.heavy.3.raw

SEQ ID NO: 456576 - DNA, 422 bp, Homo sapiens; identical to SEQ ID NO: 444681
  misc_feature: HEFZJCU01BQT3Z.16.78.H01.1.454.heavy.3.raw

SEQ ID NO: 456577 - DNA, 498 bp, Homo sapiens
  misc_feature: HEFZJCU01ESDOV.51.3.A03.1.454.heavy.3.raw
cgatcgtatacacgaccggtgctcgatttagagagcgtcacaggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaagctttgagtggatgggatggatcaccgctggcaatggtgacacaaaatattcacagaagttccagggcagagtcaccattaacagggacacatctgcgagtacaggctacatggaactgagcggcctgagatctgaggacacggctatttattactgtgcgagagggaagtgggatattgtggcagctccaggtgcccacgccggcccccgtta

SEQ ID NO: 456578 - DNA, 516 bp, Homo sapiens; identical to SEQ ID NO: 453300
  misc_feature: HEFZJCU01ASDTT.3.20.B09.1.454.heavy.3.raw

SEQ ID NO: 456579 - DNA, 495 bp, Homo sapiens; identical to SEQ ID NO: 444618
  misc_feature: HEFZJCU01A8D3H.3.26.C04.1.454.heavy.3.raw

SEQ ID NO: 456580 - DNA, 384 bp, Homo sapiens; identical to SEQ ID NO: 444454
  misc_feature: HEFZJCU01EY373.11.61.F06.1.454.heavy.3.raw

SEQ ID NO: 456581 - DNA, 487 bp, Homo sapiens
  misc_feature: HEFZJCU01CIXAS.19.53.E09.1.454.heavy.3.raw
  modified_base (478)..(478): a, c, t, g, unknown or other
tactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtncaaggaggt

SEQ ID NO: 456582 - DNA, 502 bp, Homo sapiens
  misc_feature: HEFZJCU01ASAFP.49.41.D08.1.454.heavy.3.raw
agtcgagagacacgaccggtgctcgatttagtcacgcgagaaagggaaaggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcttctggtggactctgggggaggcgtggtccggcctgggaggtccctgagactctcctgtgcagcctctcagttcaccttcagtgtctatactatgcactgggtccgccaggctccaggcaaggggctgggagtggggtggcacttatatcaaatgatggaagaattcaacactacgcaggctccgtgaagggccgattcaccatctccagagacaattccaagaacacactgtctctgcaaatgaatagcctgagagttgaggacacggctgtctattactgtgcgagagctaagggacttactcatagt

SEQ ID NO: 456583 - DNA, 470 bp, Homo sapiens
  misc_feature: HEFZJCU01EEEG2.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaaggcccatcggtcttcccctggcgccctgctccaggagcacctcccgagagcacagcggccctgggctgcctggtcaaggactacttccctacagtgct

SEQ ID NO: 456584 - DNA, 526 bp, Homo sapiens
  misc_feature: HEFZJCU01EZKUO.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctgggccggggaacctggtcaccgtctccccaccctccaccg

SEQ ID NO: 456585 - DNA, 396 bp, Homo sapiens; identical to SEQ ID NO: 444469
  misc_feature: HEFZJCU01C0HAY.47.46.E02.1.454.heavy.3.raw

SEQ ID NO: 456586 - DNA, 521 bp, Homo sapiens
  misc_feature: HEFZJCU01CW4ZW.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtcgtggggccaagggaccg

SEQ ID NO: 456587 - DNA, 316 bp, Homo sapiens
  misc_feature: HEFZJCU01CPK3I.47.84.H07.1.454.heavy.3.raw
agctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctggggacacagcggccctgggctgcctggtcaaggactacttcctacgtgagct

SEQ ID NO: 456588 - DNA, 467 bp, Homo sapiens; identical to SEQ ID NO: 445159
  misc_feature: HEFZJCU01EAIRH.48.7.A07.1.454.heavy.3.raw

SEQ ID NO: 456589 - DNA, 501 bp, Homo sapiens; identical to SEQ ID NO: 453672
  misc_feature: HEFZJCU01C7KTA.40.81.H04.1.454.heavy.3.raw

SEQ ID NO: 456590 - DNA, 485 bp, Homo sapiens
  misc_feature: HEFZJCU01BLVMD.48.38.D05.1.454.heavy.3.raw
agtatacatacacgaccggtgctcgatttagtatctgatagttgggtttggggatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagatat

SEQ ID NO: 456591 - DNA, 497 bp, Homo sapiens
  misc_feature: HEFZJCU01CMQQ9.53.26.C04.1.454.heavy.3.raw
cgcgtatacacacgaccggtgctcgatttagtctagcgactttgggtttgggggagcatcaccctgcaaccacagctgtcctctagagaatccccagagagctccgttcctcaccatggactggacctggaggatcctcttcttggtggcagcagccacaggagcccactcccaggtgcatctagtgcaatctcgggctgaggtaaagaagcctggggcctcagtgaaggtctcctgcaaggcctctggatacaccttcaccgactactatatgcactgggtgcgacaggcccctggaaaagggcttgagtggatgggatgggtcaatcctaacagtggcggcagcggtctcacagaatatgcacagaagtttcagggcagggtctccatgaccagggacagggccatcagaacagcctacatggagctgaacagactgacatctgacgacaacggcccgttttattattgtgttgagagagacccggatggacctc

SEQ ID NO: 456592 - DNA, 500 bp, Homo sapiens
  misc_feature: HEFZJCU01EV1VH.17.10.A10.1.454.heavy.3.raw
  modified_base (460)..(460): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttcngtcatcgtacaatttgataggctctatgactggacttctc

SEQ ID NO: 456593 - DNA, 518 bp, Homo sapiens
  misc_feature: HEFZJCU01DGQPA.2.85.H08.1.454.heavy.3.raw
acgctcgacacacgaccggtgctcgatttagtatcactcagtcgcggggccctgggagcacagctcatcaccatggactggacctggaggttcctctttgtggtggcagcagctacaggtgtccagtcccaggtccagctggtgcagtctggggctgaggtgaagaagcctgggtcctcggtgagggtctcctgcaaggcttctggaggcaccttcaggacctatattatgacctgggtgcgacaggcccctggacaagggcttgagtggctggggggatcatccctatgtttggtgaagcaaattacgcacagaagttccggggaagagtctcgattaccgcggacgaatccacgaacacagcctacatggaagtgaccagcctgagatctgaagacacggccgtgtattactgtgcgaagtcgtattactatgatactggtgattatttgaatttcgactcctaccactacggtatggacgtctggggccagggggaccacggtcaccgtctcgtt

SEQ ID NO: 456594 - DNA, 523 bp, Homo sapiens; identical to SEQ ID NO: 446270
  misc_feature: HEFZJCU01CQSJT.12.40.D07.1.454.heavy.3.raw

SEQ ID NO: 456595 - DNA, 497 bp, Homo sapiens
  misc_feature: HEFZJCU01EJ343.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggcctgggctgcctggtcaaggactaccg

SEQ ID NO: 456596 - DNA, 515 bp, Homo sapiens
  misc_feature: HEFZJCU01AEFPO.52.40.D07.1.454.heavy.3.raw
cgcagtacgacacgaccggtgctcgatttagtgatagagcgtaacaacagagggacagggtctgtgaagccttcacagaccctgtccctcacctgcactgtctctggtggctccatcaacagtggtagtttcttctggacctggatccggcagcccgccgggaagggactggagtggattgggcgtatccataccagtggcatcaccgagtacaccccttccctcaagagtcgactctccatatcactagacgcgtccaagaaccaggtcttcctgatggtgagctctgtgaccgccgcagactcggccagatattactgtgcgagagcgggggcggctaatgtcgcaggctattacttcggtttggacgtctggggccaagggaccacggtcaccgtctccgcagcctccaccaagggcccatcggtcttccccctggcaccctcctccaagagcacctctgggggcacagcggccctgggctgcctggtcagggactacttcctatacgatcg

SEQ ID NO: 456597 - DNA, 520 bp, Homo sapiens
  misc_feature: HEFZJCU01E1093.40.65.F10.1.454.heavy.3.raw
tctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgtatgcctttgatatgttggggccgaaggggacaactaggtcaccgtctcttctacgcctccacccaacgggacccgactcc

SEQ ID NO: 456598 - DNA, 520 bp, Homo sapiens
  misc_feature: HEFZJCU01EHO6T.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggcccggggaaccctggtcgccgtctcctcagcctccaccaagggcccatcggtcttccccctggcaccctcctccaagagcacctctgggggcacagcggccctgggctgcctggtcaaggactacttccagacgtatca

SEQ ID NO: 456599 - DNA, 524 bp, Homo sapiens; identical to SEQ ID NO: 445902
  misc_feature: HEFZJCU01EXDYS.9.78.H01.1.454.heavy.3.raw

SEQ ID NO: 456600 - DNA, 524 bp, Homo sapiens; identical to SEQ ID NO: 445902
  misc_feature: HEFZJCU01COYXX.9.78.H01.1.454.heavy.3.raw

SEQ ID NO: 456601 - DNA, 543 bp, Homo sapiens
  misc_feature: HEFZJCU01C253H.18.14.B03.1.454.heavy.3.raw
tacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaactctcctgtgcagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatccctgaaagcgtcaactactactactacggtatggacctcgtgggccgaagggaccacggtcaccgtctcctcagcctccaccaacgggcccatccggtcttcccccttcggccgccctcgcctccacggagcacctccgagacgcacagcc

SEQ ID NO: 456602 - DNA, 501 bp, Homo sapiens
  misc_feature: HEFZJCU01EG4US.52.86.H09.1.454.heavy.3.raw
cgcagtacgacacgaccggtgctcgatttagtgctatagacttgggtttggggagctctgggagacgagcccagcactggaagtcgccggtgtttccattcggtgatcatcactgaacacagaggactcaccatggagtttgggctgagcgtggtttctcgttaggctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgtttactgtgcgagagggaactcgattacagcacg

SEQ ID NO: 456603 - DNA, 512 bp, Homo sapiens
  misc_feature: HEFZJCU01EAV0X.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctacgtggggcccgggagcccctgggt

SEQ ID NO: 456604 - DNA, 518 bp, Homo sapiens
  misc_feature: HEFZJCU01CFS1W.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgacgttactacgctatggacgtctggggccaagggaccg

SEQ ID NO: 456605 - DNA, 507 bp, Homo sapiens
  misc_feature: HEFZJCU01DBRUU.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaaggggactgacatctgacgacacggccatgtattattgtgcgagagaaatgttaggtactgctttgggtccctggggcccggggaaccgggtc

SEQ ID NO: 456606 - DNA, 524 bp, Homo sapiens; identical to SEQ ID NO: 446401
  misc_feature: HEFZJCU01C65DD.3.82.H05.1.454.heavy.3.raw

SEQ ID NO: 456607 - DNA, 501 bp, Homo sapiens; identical to SEQ ID NO: 452399
  misc_feature: HEFZJCU01DWYIL.40.81.H04.1.454.heavy.3.raw

SEQ ID NO: 456608 - DNA, 520 bp, Homo sapiens; identical to SEQ ID NO: 447654
  misc_feature: HEFZJCU01BZ9NS.10.79.H02.1.454.heavy.3.raw

SEQ ID NO: 456609 - DNA, 379 bp, Homo sapiens; identical to SEQ ID NO: 444450
  misc_feature: HEFZJCU01CGYHH.47.77.G11.1.454.heavy.3.raw

SEQ ID NO: 456610 - DNA, 513 bp, Homo sapiens
  misc_feature: HEFZJCU01D3SYW.16.28.C06.1.454.heavy.3.raw
tgtactactccacgaccggtgctcgatttagagctcacgtattgggtttggggggaagaggaagactgacggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccggttcaccatctccagagacaatcccaagaacacgctgtatctgcaaatgaacggcctgagagccgaggacacggccgtatattactgtgcccgagggaggttttactatgatattactggttacaaaaagggtactactttgactactggggccagggaaccctggtcaccgtctcctcagcctccaccaagggcccatcggtcttcccctggcgccctgctccaggagcacctccgagaacacagcggccctgggctgcctggtcaaggactacttccgagtagtaca

SEQ ID NO: 456611 - DNA, 512 bp, Homo sapiens; identical to SEQ ID NO: 445688
  misc_feature: HEFZJCU01AT183.3.34.D01.1.454.heavy.3.raw

SEQ ID NO: 456612 - DNA, 508 bp, Homo sapiens
  misc_feature: HEFZJCU01EVI2R.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgacgaaagatctcgggctggttccgcggtccgggt

SEQ ID NO: 456613 - DNA, 497 bp, Homo sapiens
  misc_feature: HEFZJCU01DYV2E.49.4.A04.1.454.heavy.3.raw
agtcgagagacacgaccggtgctcgatttagagtagtgatcagggggggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtgggtggcatttatctcatatgatggaagcaagatatactacattgactccgtgaagggccgattcatcatctccagagacaactccgagaacacactgtatcttcaaatgaacaggttgagagctgaaagacacggctttatattactgtgcgaaactttaatcacggaggacaacggtccg

SEQ ID NO: 456614 - DNA, 482 bp, Homo sapiens; identical to SEQ ID NO: 444503
  misc_feature: HEFZJCU01BVMU0.7.10.A10.1.454.heavy.3.raw

SEQ ID NO: 456615 - DNA, 485 bp, Homo sapiens
  misc_feature: HEFZJCU01EH9DI.51.67.G01.1.454.heavy.3.raw
cgatcgtatacacgaccggtgctcgatttagagtatacatattgggtttggggggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaacttaatcaac

SEQ ID NO: 456616 - DNA, 517 bp, Homo sapiens
  misc_feature: HEFZJCU01AVQ7K.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggtctacttcgatctct

SEQ ID NO: 456617 - DNA, 383 bp, Homo sapiens; identical to SEQ ID NO: 446695
  misc_feature: HEFZJCU01A1WIT.22.85.H08.1.454.heavy.3.raw

SEQ ID NO: 456618 - DNA, 513 bp, Homo sapiens
  misc_feature: HEFZJCU01EQC1K.9.12.B01.1.454.heavy.3.raw
tgatacgtctcacgaccggtgctcgatttagtagtgtagattccgcgggggcagctctgggagaggagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactgggtccgccaggctccagggaaggggctggagtgggtctcagttatttatagcggtggtaacacatactacgcagactccgtgaagggcagattcaccatctccagagacaattccaggaacacgctgtatcttacaaatgaacagcctgagagtcgaggacacggctgtatattactgtgcgagagagtgtgtacgtcttttgatatcgtggggaccg

SEQ ID NO: 456619 - DNA, 513 bp, Homo sapiens
  misc_feature: HEFZJCU01BPHR4.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaaggcccatcggtcttcccctggcgccctgctccaggagcacctctgggggcacagcggcccg

SEQ ID NO: 456620 - DNA, 497 bp, Homo sapiens
  misc_feature: HEFZJCU01CAPTI.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagtttgagcagcctgagatctgacgacacggccgttttattactgtgcgcgagataatagtcacaactggaacggcgttttggggt

SEQ ID NO: 456621 - DNA, 512 bp, Homo sapiens
  misc_feature: HEFZJCU01EX2SB.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccaggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatacctacttttgactactggggaccg

SEQ ID NO: 456622 - DNA, 506 bp, Homo sapiens
  misc_feature: HEFZJCU01D2F97.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctgggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccatatatttctgtgcgtcgaggaatttcgacttctggaataattacttgggttaggaaactacctta

SEQ ID NO: 456623 - DNA, 518 bp, Homo sapiens; identical to SEQ ID NO: 449255
  misc_feature: HEFZJCU01COO68.3.17.B06.1.454.heavy.3.raw

SEQ ID NO: 456624 - DNA, 481 bp, Homo sapiens
  misc_feature: HEFZJCU01BA2W6.40.83.H06.1.454.heavy.3.raw
tctagcgactcacgaccggtgctcgatttagatcacgtgcgtcgcggggtgggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtcactgagactctcctgtgcatcgtccggattcaccttccataaatataacatgcactgggtccgccaggctccaggcaagggactgcagtggctggccactgtctggtcggatgaaagttatgcatactatgcagactctctgaggggccgattcatcatctctagagacaattcgaagaacacggcttatctgcaaatgaacagacctgacagtcgaggacacggctgtatatttctgtgacgatgaggaa

SEQ ID NO: 456625 - DNA, 489 bp, Homo sapiens
  misc_feature: HEFZJCU01CF22F.48.37.D04.1.454.heavy.3.raw
agtatacatacacgaccggtgctcgatttagtagcatactgttgggtttgggggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaggactacttcctatgtatact

SEQ ID NO: 456626 - DNA, 542 bp, Homo sapiens
  misc_feature: HEFZJCU01B76PS.16.39.D06.1.454.heavy.3.raw
tgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccgattcaccatctccagagacaattccaagaacacggtgaatcttcaaatgaacagcctgagaaccgaggacacggccgtatattattgtataggttatggtggtaattcgggccctggggccagggaaccgtggtcaccgtctcctcagcctccaccg

SEQ ID NO: 456627 - DNA, 545 bp, Homo sapiens
  misc_feature: HEFZJCU01A1UZG.18.14.B03.1.454.heavy.3.raw
tacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtggattacatttgggggagttatcgcaaacgggggggtactactacgctatggacgtctggggccaagggaccacggtcaccgtctctcagcctccaccaggccatcggtcttcccctggcaccctcctccagagcacctctggggcacg

SEQ ID NO: 456628 - DNA, 495 bp, Homo sapiens; identical to SEQ ID NO: 446614
  misc_feature: HEFZJCU01C5PTR.13.85.H08.1.454.heavy.3.raw

SEQ ID NO: 456629 - DNA, 518 bp, Homo sapiens; identical to SEQ ID NO: 449255
  misc_feature: HEFZJCU01DKHEJ.3.17.B06.1.454.heavy.3.raw

SEQ ID NO: 456630 - DNA, 501 bp, Homo sapiens; identical to SEQ ID NO: 445027
  misc_feature: HEFZJCU01D5444.26.23.C01.1.454.heavy.3.raw

SEQ ID NO: 456631 - DNA, 509 bp, Homo sapiens; identical to SEQ ID NO: 444586
  misc_feature: HEFZJCU01DTCTY.12.78.H01.1.454.heavy.3.raw

SEQ ID NO: 456632 - DNA, 379 bp, Homo sapiens; identical to SEQ ID NO: 444450
  misc_feature: HEFZJCU01DPQQH.47.77.G11.1.454.heavy.3.raw

SEQ ID NO: 456633 - DNA, 483 bp, Homo sapiens
  misc_feature: HEFZJCU01A7SV3.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctatcacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggactacttccgtatctctcg

SEQ ID NO: 456634 - DNA, 506 bp, Homo sapiens; identical to SEQ ID NO: 446520
  misc_feature: HEFZJCU01CZ74V.10.38.D05.1.454.heavy.3.raw

SEQ ID NO: 456635 - DNA, 506 bp, Homo sapiens; identical to SEQ ID NO: 444696
  misc_feature: HEFZJCU01EX8OR.16.34.D01.1.454.heavy.3.raw

SEQ ID NO: 456636 - DNA, 518 bp, Homo sapiens
  misc_feature: HEFZJCU01DY2KB.49.11.A11.1.454.heavy.3.raw
agtcgagagacacgaccggtgctcgatttagctacgactgcaagggggggagaggagccccagccttgggattcccaagtgttttcattcagtgatcaggactgaacacagaggactcaccatggagtttgggctgacctggattttccttgctgctattttaaaaggtgtccagtgtcaggtccagctggtggagtctgggggaggcttggtaaggcctggggggtcccttagactctcctgtgcagcctctggattcaatttcaatgacgcctggatgagctgggtccgacaggctccagggaaggggctggagtgggttgcccgtattaaaagcagagttgatggtgggacaagagagtacgctgcgaccgtgaaaggcagagtcagcatctcaagagatgattcaagagacacggtgtttctgcaattgaccagcctgaaaacggaggacacagccgtgtattactgtgccacgtggcaccatggatacgcctattcttacaaagagggacttc

SEQ ID NO: 456637 - DNA, 385 bp, Homo sapiens; identical to SEQ ID NO: 444438
  misc_feature: HEFZJCU01AE4MI.18.60.F05.1.454.heavy.3.raw

SEQ ID NO: 456638 - DNA, 496 bp, Homo sapiens; identical to SEQ ID NO: 444697
  misc_feature: HEFZJCU01EXUI1.16.37.D04.1.454.heavy.3.raw

SEQ ID NO: 456639 - DNA, 519 bp, Homo sapiens; identical to SEQ ID NO: 444867
  misc_feature: HEFZJCU01EW18X.9.34.D01.1.454.heavy.3.raw

SEQ ID NO: 456640 - DNA, 519 bp, Homo sapiens; identical to SEQ ID NO: 445330
  misc_feature: HEFZJCU01CH1I1.7.78.H01.1.454.heavy.3.raw

SEQ ID NO: 456641 - DNA, 390 bp, Homo sapiens; identical to SEQ ID NO: 444654
  misc_feature: HEFZJCU01DO0O8.16.17.B06.1.454.heavy.3.raw

SEQ ID NO: 456642 - DNA, 494 bp, Homo sapiens
  misc_feature: HEFZJCU01ECTF8.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttccccctggccaccctcctccaagagcacctcgtgggggcacagcggccctgggctgcctggtcaaggactacttccgtatctctcg

SEQ ID NO: 456643 - DNA, 496 bp, Homo sapiens
  misc_feature: HEFZJCU01DZ4HN.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagttgagcagcctgagatctgacgacacggccgttttattactgtgcgcgagataatagtcacaactggaacggcgttttggggt

SEQ ID NO: 456644 - DNA, 513 bp, Homo sapiens; identical to SEQ ID NO: 446699
  misc_feature: HEFZJCU01EWORL.12.25.C03.1.454.heavy.3.raw

SEQ ID NO: 456645 - DNA, 493 bp, Homo sapiens; identical to SEQ ID NO: 453100
  misc_feature: HEFZJCU01BCBUD.14.25.C03.1.454.heavy.3.raw

SEQ ID NO: 456646 - DNA, 511 bp, Homo sapiens
  misc_feature: HEFZJCU01A036D.48.73.G07.1.454.heavy.3.raw
agtatacatacacgaccggtgctcgatttagctctacgctcagggcacgaccggtgctcgatttagctctacgctcagggcacgaccggtgctcgatttagagagagtgtgttgggtttgggggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaaggcccatcggtcttcccctggcgccctgctcca

SEQ ID NO: 456647 - DNA, 521 bp, Homo sapiens; identical to SEQ ID NO: 445317
  misc_feature: HEFZJCU01AXUPC.12.40.D07.1.454.heavy.3.raw

SEQ ID NO: 456648 - DNA, 533 bp, Homo sapiens; identical to SEQ ID NO: 446098
  misc_feature: HEFZJCU01C3P1B.7.78.H01.1.454.heavy.3.raw

SEQ ID NO: 456649 - DNA, 516 bp, Homo sapiens
  misc_feature: HEFZJCU01CWUAE.48.41.D08.1.454.heavy.3.raw
agtatacatacacgaccggtgctcgatttagtcacgcgagaaagggaaaggggggagaggagccccagccctgagaatcccaggtgtttccattcagtgatcagcactgaacacagaggactcaccatggagttgggactgagctggattttccttttgactattttaaaaggtggtcactgtgaacggctactggtggagtctggggaggcttggtacagcctggcaggtccctgaaactctcctgtgtagcctctggattcaggttgggcgattatgccatgcaatgggtccggcaaggtccagggaagggcctggagtgggtctcaggcatcgattggaaaagcgagaagattgactatgcggagtctgtgaaggggcgattcatcatctccagagacaacgccaagaactccctgtatttgcagatgaacatctgagacctgacgacacggccttgtattattgtgacaaaagtttgtggagtcactagtctctggactacggtatggtacg

SEQ ID NO: 456650 - DNA, 385 bp, Homo sapiens; identical to SEQ ID NO: 444438
  misc_feature: HEFZJCU01AQAHG.18.60.F05.1.454.heavy.3.raw

SEQ ID NO: 456651 - DNA, 500 bp, Homo sapiens
  misc_feature: HEFZJCU01CFKL6.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtgggtgggtcagcggctttgacggtaaggcacagtatgcaccgaagatgaagggcagagtcacgattaccacgggaccacccccacgaacacagtctacatgcaactgacgagcctgagagctgacgacacggccgtctattactgtgcgagaatgttttctgtcatcgtacaatttgataggctctatggactggacttc

SEQ ID NO: 456652 - DNA, 523 bp, Homo sapiens
  misc_feature: HEFZJCU01DO2HI.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctggattttccctgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccct

SEQ ID NO: 456653 - DNA, 496 bp, Homo sapiens; identical to SEQ ID NO: 448481
  misc_feature: HEFZJCU01BIEUE.4.21.B10.1.454.heavy.3.raw

SEQ ID NO: 456654 - DNA, 509 bp, Homo sapiens; identical to SEQ ID NO: 453913
  misc_feature: HEFZJCU01A1E2S.22.82.H05.1.454.heavy.3.raw

SEQ ID NO: 456655 - DNA, 506 bp, Homo sapiens
  misc_feature: HEFZJCU01ELP3G.48.81.H04.1.454.heavy.3.raw
agtatacatacacgaccggtgctcgatttagtagtgtagattcgcggggatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcgggggaggtggacggagctcggttttcggagtttatcatctactactttg

SEQ ID NO: 456656 - DNA, 531 bp, Homo sapiens
  misc_feature: HEFZJCU01DBH3R.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggaacggtcgacgacgtccgtcccaccctccctacccg

SEQ ID NO: 456657 - DNA, 499 bp, Homo sapiens
  misc_feature: HEFZJCU01C966S.51.59.F04.1.454.heavy.3.raw
cgatcgtatacacgaccggtgctcgatttagtacacacacttagggattggggtctgggagacgagcccagcactggaagtcgccggtgtttccattcggtgatcatcactgaacacagaggactcaccatggagtttgggctgagctgggttttcctcgttgctcttttaagagggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgtttactgtgcgagagggaactcgattacagcag

SEQ ID NO: 456658 - DNA, 507 bp, Homo sapiens
  misc_feature: HEFZJCU01A2XKZ.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacgagtggcagctcaagtacttac

SEQ ID NO: 456659 - DNA, 515 bp, Homo sapiens
  misc_feature: HEFZJCU01CQ6QG.9.34.D01.1.454.heavy.3.raw
tgatacgtctcacgaccggtgctcgatttagatcgtctgtgttgggtttaggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcagactactccagacgtatca

SEQ ID NO: 456660 - DNA, 483 bp, Homo sapiens
  misc_feature: HEFZJCU01D50T3.40.83.H06.1.454.heavy.3.raw
tctagcgactcacgaccggtgctcgatttagatcacgtgcgtcgcggggagctctgggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtcactgagactctcctgtgcatcgtccggattcaccttccataaatataacatgcactgggtccgccaggctccaggcaagggactgcagtggctggccactgtctggtcggatgaaagttatgcatactatgcagactctctggaggggccgattcatcatctctagagacaattacgaagaacacggtcttatctgacaaatagaacacgtcctgacagtcggaggacgacggctgtattatttctgt

SEQ ID NO: 456661 - DNA, 535 bp, Homo sapiens
  misc_feature: HEFZJCU01COGOR.11.10.A10.1.454.heavy.3.raw
cgagagataccacgaccggtgctcgatttagcgtcgatctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacaggtcagcttccatgtgacgcccggagacagaaggtctctgggtggctgggtttttgtggggtgaggatggacattctgccattgtgattactactactactactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 456662 - DNA, 489 bp, Homo sapiens
  misc_feature: HEFZJCU01EHH0L.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttccccctggcgccctgctccaggagcacctccgagagcacagcggccctgggctgcctggcaaggactacttcctacgtgagct

SEQ ID NO: 456663 - DNA, 505 bp, Homo sapiens
  misc_feature: HEFZJCU01C3162.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaagggctggagtgggttggtcgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacacgac

SEQ ID NO: 456664 - DNA, 414 bp, Homo sapiens; identical to SEQ ID NO: 444901
  misc_feature: HEFZJCU01D94C5.51.70.G04.1.454.heavy.3.raw

SEQ ID NO: 456665 - DNA, 505 bp, Homo sapiens; identical to SEQ ID NO: 446473
  misc_feature: HEFZJCU01A5A30.13.37.D04.1.454.heavy.3.raw

SEQ ID NO: 456666 - DNA, 495 bp, Homo sapiens; identical to SEQ ID NO: 445359
  misc_feature: HEFZJCU01CX9PL.4.21.B10.1.454.heavy.3.raw

SEQ ID NO: 456667 - DNA, 499 bp, Homo sapiens
  misc_feature: HEFZJCU01CIYZD.51.23.C01.1.454.heavy.3.raw
cgatcgtatacacgaccggtgctcgatttagtacacgtgattagggattgggggcatcacataacaaccagattcctcctctaaagaagcccctgggagcacagctcatcaccatggactggacctggaggttcctctttgtggtggcagcagttacaggtgtccattcccaggtccagctggtgcagtctggggctgaggtgaagatgcctgggtcctcggtgaaggtctcctgcaagtattctggaggcaccttcagcaactatggtatcagctgggtgcgacaggcccctggacaagggcttgagtggatgggaagggtcacccctatatttgatgtagcagactctgcacagaagttccagggcagaataacaattacggcggacaaatccacgaccacagcctacatggagctgagcagcctgagatctgaggacacggcccttttatactgtgcgagatttaccgtgggggtcacggcggatatatcgccata

SEQ ID NO: 456668 - DNA, 496 bp, Homo sapiens
  misc_feature: HEFZJCU01DPREI.51.78.H01.1.454.heavy.3.raw
cgatcgtatacacgaccggtgctcgatttagtgtgagtagtttgggtttgggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaacccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 456669 - DNA, 489 bp, Homo sapiens; identical to SEQ ID NO: 444791
  misc_feature: HEFZJCU01DISJ1.47.85.H08.1.454.heavy.3.raw

SEQ ID NO: 456670 - DNA, 528 bp, Homo sapiens
  misc_feature: HEFZJCU01BPB7F.9.43.D10.1.454.heavy.3.raw
  modified_base (463)..(463): a, c, t, g, unknown or other
tgatacgtctcacgaccggtgctcgatttagactagcagtaagggggggagaggagcccagcactgggattccgaggtgtttccattcggtgatcagcactgaacacagaggactcaccatggagttttggctgagcgtgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtncgagacagtgacttcggtgaccccgtgggggcccaagggaaccctggtcaccggtcctccgtcag

SEQ ID NO: 456671 - DNA, 504 bp, Homo sapiens
  misc_feature: HEFZJCU01CVM0T.17.20.B09.1.454.heavy.3.raw
cgtagactagcacgaccggtgctcgatttagtgtagtgtgaagggggggagaggagcccagcactacaagtcggcggtgtttccattcggtgatcaacactgaacacagaggactcaccatggagtttcggctgcgctgggtttttctcgttgctcttttaagaggtgtccagtgtcaggtgcagctggtggagtctgggggaggcgtggtccagcctgggaggtccctgagactttcttgtgaagcgtctggattcaccttcagtgcctatggcatgcactgggtccgccaggctccaggcaaggggctggagtgggtggcacttatatggtatgatggaaataataaattctatgcagactccgtgaagggccgattcacgtctccagagacaattccaaggacacggtgtatctacaaatgaacagcctgagagtcgaagacacggcgacttattactgtgcgagagatctgggtgcatatagtgacggttttatgccgtt

SEQ ID NO: 456672 - DNA, 488 bp, Homo sapiens; identical to SEQ ID NO: 444617
  misc_feature: HEFZJCU01A8QGV.4.6.A06.1.454.heavy.3.raw

SEQ ID NO: 456673 - DNA, 517 bp, Homo sapiens
  misc_feature: HEFZJCU01CYLYI.52.78.H01.1.454.heavy.3.raw
cgcagtacgacacgaccggtgctcgatttagtgtgagtagtttgggtttggggttgagctgggttttccttgttgctattttagaaggtgtccagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttcccctggcc

SEQ ID NO: 456674 - DNA, 491 bp, Homo sapiens
  misc_feature: HEFZJCU01AERTS.40.85.H08.1.454.heavy.3.raw
tctagcgactcacgaccggtgctcgatttagtatcactcagtcgcggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctcgtgacgacacggccatgtattactgtggaagagacgttggtggctaccgcggggctgaccactggggccagggaaccctggtcaccgtctcctcagcctccaccaagggcccatcggtcttcccctggcgccctgctccaggagcacctccgagagcacagcggccctgggctgcctggtcaaggactacttccagtcgctaga

SEQ ID NO: 456675 - DNA, 516 bp, Homo sapiens
  misc_feature: HEFZJCU01AOLLH.18.6.A06.1.454.heavy.3.raw
tacgagtatgcacgaccggtgctcgatttagatctactgacaacgtacgacaaggggctgggagaggacgcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaaggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcagtttacttgaccctggggccgggaacctggtcaccgt

SEQ ID NO: 456676 - DNA, 513 bp, Homo sapiens
  misc_feature: HEFZJCU01B7AIH.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgcctgctccaggagcacctctggggcgacagcggcccg

SEQ ID NO: 456677 - DNA, 502 bp, Homo sapiens
  misc_feature: HEFZJCU01BTJWC.10.34.D01.1.454.heavy.3.raw
catagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccatattaaaaatcaaagctgatggtgggacaacagagcacgctgcacccgtgaaaggcagattcagcatctcaagagatgattcaaaaagtacgctgtatctgaacatgaacagcctagaaaacgggaggacacagccgtgtattactgtgccactcaggaccgatattgtt

SEQ ID NO: 456678 - DNA, 451 bp, Homo sapiens
  misc_feature: HEFZJCU01APK7S.9.53.E09.1.454.heavy.3.raw
tgatacgtctcacgaccggtgctcgatttagagagagtgtgggtttggggagatctggttcttggacgtgtctactgacatggtgactcgactcttgaggaagggactggagtgggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaagggcccatcggtcttccccctggcgccctgctccaggagcacctccgacgagcacagcggccctgggctgcctggtcaaggactacttccagacgtatca

SEQ ID NO: 456679 - DNA, 315 bp, Homo sapiens
  misc_feature: HEFZJCU01DJGOK.13.17.B06.1.454.heavy.3.raw
tcacgtactacacgaccggtgctcgatttagtcgatagtgaagggccgattcaccatctccagagacaacgccaagaactcactgtatctgcagatgaccagcctgagagtcgaggatacggctgtgtattattgtgcgagagatggggcacgacattttgtagaggtgtactggggccagggagccccggtcaccgtctcctcagcctccaccaagggcccatcggtcttccccctggcgccctgctccaggagcacctccgagagcacagcggccctgggctgcctggtcaaggactacttccgtactagacg

SEQ ID NO: 456680 - DNA, 518 bp, Homo sapiens; identical to SEQ ID NO: 451556
  misc_feature: HEFZJCU01CDD0F.13.76.G10.1.454.heavy.3.raw

SEQ ID NO: 456681 - DNA, 496 bp, Homo sapiens
  misc_feature: HEFZJCU01C5LOP.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagccggccgtgggctcgccgtggtacgaaggactaccttcctacgtgacgct

SEQ ID NO: 456682 - DNA, 506 bp, Homo sapiens
  misc_feature: HEFZJCU01EGX1P.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggttccgcggtccgg

SEQ ID NO: 456683 - DNA, 504 bp, Homo sapiens
  misc_feature: HEFZJCU01DSS7B.3.85.H08.1.454.heavy.3.raw
agacgcactccacgaccggtgctcgatttagtatcactcagtcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctggtggagtctgggggaggcttggtacagcctggggggtccctgagactctcctgtgcagcctctggattcacctttagtaattatgccatgagctgggtccgccaggctccagggaaggggctggagtgggtctcagctattagtgatcgtggtggtaacacatactacgcagactccgtgaaggccgcttcaccatctccagagacaattccaagaacacgctgcatctgcaaatgaacagcctgagagccgaggacacggccctttattactgtgcgaaacaatcacgtataactggaactacgta

SEQ ID NO: 456684 - DNA, 538 bp, Homo sapiens
  misc_feature: HEFZJCU01CHRXG.51.49.E05.1.454.heavy.3.raw
cgatcgtatacacgaccggtgctcgatttagagcgactagcaacacacaaagggggtggtttctgagagtcatggacctcctggacaagaacatgaaacccctgtggttcttcctcctcctggtggcagctcccagatgggtcctgtcccaggtgcaactgcagcagaggggcgcaagactgttgaagcctttggagaccctgtccctcacctgcactctttctggtgcgactttcagtggttatttctgggctgggtccgccagcccccgggaagggacttcagtggattggggaaatcagtcgtagtggagagaccttctacaacccgtccctcaagagtcgagtcgccatatcaacagacgcgtccaagagtgaggtgtccctgacactcaggtctgtgaccgccgcggacgcggctgtatactactgtgcgagagtccccgctgggttttggagtggttattatgccggtatggacgtctgggggcgcgagggaccacggtcgccgtctcttcagcctccaccaagggcccacg

SEQ ID NO: 456685 - DNA, 519 bp, Homo sapiens
  misc_feature: HEFZJCU01ETQ79.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggttttggggcgcggactcctcttgagatctggggccaggggacaatggtcaccgtctcttca

SEQ ID NO: 456686 - DNA, 504 bp, Homo sapiens
  misc_feature: HEFZJCU01EEVA3.48.23.C01.1.454.heavy.3.raw
agtatacatacacgaccggtgctcgatttagtacacgtgattagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgattgcctttgatatgtggggccaagggacaatggtacg

SEQ ID NO: 456687 - DNA, 392 bp, Homo sapiens; identical to SEQ ID NO: 444456
  misc_feature: HEFZJCU01BWIZK.7.60.F05.1.454.heavy.3.raw

SEQ ID NO: 456688 - DNA, 503 bp, Homo sapiens
  misc_feature: HEFZJCU01CZZ14.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcagtggcttttgtatgcctttgtatatgtggggccgtaagggacaagtggtcaccggtct

SEQ ID NO: 456689 - DNA, 498 bp, Homo sapiens; identical to SEQ ID NO: 451503
  misc_feature: HEFZJCU01AMRDU.17.10.A10.1.454.heavy.3.raw

SEQ ID NO: 456690 - DNA, 505 bp, Homo sapiens; identical to SEQ ID NO: 446616
  misc_feature: HEFZJCU01CK3QD.51.65.F10.1.454.heavy.3.raw

SEQ ID NO: 456691 - DNA, 521 bp, Homo sapiens
  misc_feature: HEFZJCU01D1CS6.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggttttggggcgcggactcctcttgagatctggggccgaggggacaatggtcaccgtctctttca

SEQ ID NO: 456692 - DNA, 502 bp, Homo sapiens
  misc_feature: HEFZJCU01C36HI.48.34.D01.1.454.heavy.3.raw
agtatacatacacgaccggtgctcgatttagatcgtctgtgttgggaggtgtggtccagcctgggaagtccctgacactgtcctgcgcagttcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctcaccaagggcccatcggtcttcccctggcgccctgctccaggagcacctccgagagcacagcggccctgggctgcctggtcaaggactacttcctatgtatact

SEQ ID NO: 456693 - DNA, 503 bp, Homo sapiens
  misc_feature: HEFZJCU01BH5B7.11.26.C04.1.454.heavy.3.raw
cgagagataccacgaccggtgctcgatttagtctagcgactttgggtttgggggaggcttggtccagcctggggggtccctgagactctcctgtgcagcctctggcatcactttcagtgacgcctggatgagctgggtccgccaggctccagggaaggggctggagtgggttggccgtattaaaagcgaggctgctggtgggacaacagactacgctgcacccgtgaagggcagattcaccatctccagagatgattcaaggagcacagtgtttctacaaatgaacagcctgactgccggggacactgccgtgtattactgtgccagcagcagcacctggccactatatttctttgacttctggggccagggaaccctggccaccgtctcctcagcttccaccaagggcccatcggtcttcccctggcgccctgctccaggagcacctctgggggcacagcggccctgggctgcctggtcaaggactacttccgtatctctcg

SEQ ID NO: 456694 - DNA, 406 bp, Homo sapiens; identical to SEQ ID NO: 445177
  misc_feature: HEFZJCU01D1LOD.51.77.G11.1.454.heavy.3.raw

SEQ ID NO: 456695 - DNA, 497 bp, Homo sapiens
  misc_feature: HEFZJCU01EDPJO.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaaacgatgctttgatatgtgggccg

SEQ ID NO: 456696 - DNA, 512 bp, Homo sapiens
  misc_feature: HEFZJCU01BDF22.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggacgcacctccgagagcacagcggccctggg

SEQ ID NO: 456697 - DNA, 512 bp, Homo sapiens; identical to SEQ ID NO: 445688
  misc_feature: HEFZJCU01BAKIQ.3.34.D01.1.454.heavy.3.raw

SEQ ID NO: 456698 - DNA, 508 bp, Homo sapiens
  misc_feature: HEFZJCU01CN6MB.48.34.D01.1.454.heavy.3.raw
agtatacatacacgaccggtgctcgatttagatcgtctgtgttgggtttggggctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggaggg

SEQ ID NO: 456699 - DNA, 530 bp, Homo sapiens
  misc_feature: HEFZJCU01EK5ZO.49.71.G05.1.454.heavy.3.raw
agtcgagagacacgaccggtgctcgatttagtgtcgtcgcaagagagaggggggagtctccttcaccacccagcggggatctcacggcttccttttctgtcctcctccaggatggggtcaaccgccatcctcgccctcctcctggctgttctccaaggagtctgtgccgaagtgcagctggtgcagcccggagcggtaatgaaaagcccggggagtctctgaggatctcctgtaagggttctggatacagctttagtaccttctggatcacctgggtgcgccagctgcccgggaaaggcctggaatggatggggaggattgaccccagtgactccagtaccaactacagtccgtccttcgaaggccacgtcagcatctcacttgacgtgtccaccaccactgtctacctacagtggcgcagcctcagacatcggacaccgccacctattactgtgcacgacgccgttataccagaggctggtaccttgactcctggggccaggggcaccctcggtcaccgtctcctcacg

SEQ ID NO: 456700 - DNA, 396 bp, Homo sapiens
  misc_feature: HEFZJCU01D5UKJ.18.31.C09.1.454.heavy.3.raw
tacgagtatgcacgaccggtgctcgatttagacgtctcatcaaggaaggaaggggctggagtggatttcatacattagtagtgctggcaatgccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaagagcacctctgggggcacagcggccctgggctgcctggtcaaggactacttcccatactcgta

SEQ ID NO: 456701 - DNA, 501 bp, Homo sapiens
  misc_feature: HEFZJCU01DXIGV.19.86.H09.1.454.heavy.3.raw
tactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataagtggttcgaccccg

SEQ ID NO: 456702 - DNA, 530 bp, Homo sapiens
  misc_feature: HEFZJCU01EVLVF.48.86.H09.1.454.heavy.3.raw
  modified_base (518)..(518): a, c, t, g, unknown or other
agtatacatacacgaccggtgctcgatttagtgctatagacttgggtttggggggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaactgctttgtctctggaacttctatcaagggtagcagcttctactggggctggatccgccagcccccaggaaaggggctacaatgggttggaaatgtcaattcttatgggcgctcccactacaatccggccctccagagtcgagccctcatatccatagacacgtccaacaaccagtttccctgacgctgacgtctgtgaccgccgcagacacggctgtctattattgtgcgagactaggcttctgtagtggtggtacttgcaacccgggatactactccaacttcggcttggacatctgggccaagggacctcggtcgccgtttccncacgcctccacc

SEQ ID NO: 456703 - DNA, 423 bp, Homo sapiens; identical to SEQ ID NO: 444772
  misc_feature: HEFZJCU01CJJHE.16.78.H01.1.454.heavy.3.raw

SEQ ID NO: 456704 - DNA, 507 bp, Homo sapiens
  misc_feature: HEFZJCU01ASIU9.21.4.A04.1.454.heavy.3.raw
tcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactgggtccgccaggctccagggaagggctggagtgggtcgccgtattacaaggaaagctaaacagttacagtacagaatacggcgcgtctgtgaaaggaaggttcaccatctcaagagatgattcaaagaactcactgtatctgcaaatgaacagcctgaaaaccgaggacacggccgtgtattattgtggtagacaaaagagtggatgtggtggtagct

SEQ ID NO: 456705 - DNA, 492 bp, Homo sapiens
  misc_feature: HEFZJCU01EG6PB.4.57.F02.1.454.heavy.3.raw
agcactgtagcacgaccggtgctcgatttagctcgatatagttgggtttgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctgggggcacgagcggccctgggctgcctggtcaaggactacttccctacagtgct

SEQ ID NO: 456706 - DNA, 525 bp, Homo sapiens
  misc_feature: HEFZJCU01BDAUY.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactgggggccaggggaagcttggtcaccggtctcctcagcctcc

SEQ ID NO: 456707 - DNA, 554 bp, Homo sapiens
  misc_feature: HEFZJCU01C7ACT.18.14.B03.1.454.heavy.3.raw
tacgagtatgcacgaccggtgctcgatttagtgtgagtagtttgggctgagctgggttttccttgttgctattttaaaaggtgtccagtgtgaggtgcagctggtggagtccgggggaggcttggtccagcctggggggtccctgaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaaccgaggacacggccgtgtattactgtactagacaggtggattacatttgggggagttagtcgcaaacgggggggtactactacgctatggacgtctggggccaagggaccacggtcaccgtctcctcagcctccaccaagggcccatcggtcttcccctggcaccctcctccaagagcacctttgggggcacacg

SEQ ID NO: 456708 - DNA, 529 bp, Homo sapiens
  misc_feature: HEFZJCU01BX7KD.13.38.D05.1.454.heavy.3.raw
tcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctggggggggcttggttaagcctggggggtccctcagactctcctgtgcaacctctggattcattttctctgacgcctggttgagctgggtccgccaggctcccgggaaggggctggagtgggttggccgtattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattactgtaccacagatgggccagactgcaaatggccgcgacgagttcgactacgtc

SEQ ID NO: 456709 - DNA, 511 bp, Homo sapiens; identical to SEQ ID NO: 447235
  misc_feature: HEFZJCU01B7ROT.16.21.B10.1.454.heavy.3.raw

SEQ ID NO: 456710 - DNA, 510 bp, Homo sapiens
  misc_feature: HEFZJCU01DMFHY.40.65.F10.1.454.heavy.3.raw
tctagcgactcacgaccggtgctcgatttagctacgctctaagggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgtatgtcctttgatatgtggggtccgaagggacaatggtcaccgtctctttcagcctccaccaacgggccc

SEQ ID NO: 456711 - DNA, 495 bp, Homo sapiens
  misc_feature: HEFZJCU01D1U04.52.77.G11.1.454.heavy.3.raw
cgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcactgggtccgccaggctccaggcaaggggctggagtgggtggcagttatatcatatgatggaagtaagatatactatgcagactccgtgaagggccgattcaccatttccagagacaactccaagaacacgctgtatttgcaaatgaacagcctgagagctgaggacacggctgtgtattactgtgcgaacttaatcacggaggacaac

SEQ ID NO: 456712 - DNA, 499 bp, Homo sapiens; identical to SEQ ID NO: 447220
  misc_feature: HEFZJCU01CR3OT.12.14.B03.1.454.heavy.3.raw

SEQ ID NO: 456713 - DNA, 519 bp, Homo sapiens
  misc_feature: HEFZJCU01AP3SE.12.55.E11.1.454.heavy.3.raw
  modified_base (511)..(511): a, c, t, g, unknown or other
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctatttactgtgcgaagagactacggtgtaccttttctggtatttcgatctctggggccgtggcaccctggtcactgtctcctcggtcttccaccaacgggcccatcggtcttcccctggcgccctgctccaggagcacctctgggggcacngcggcccg

SEQ ID NO: 456714 - DNA, 526 bp, Homo sapiens
  misc_feature: HEFZJCU01BGZXO.16.9.A09.1.454.heavy.3.raw
  modified_base (509)..(509): a, c, t, g, unknown or other
tgtactactccacgaccggtgctcgatttagcgagacgcgcagggggagagaggggcccagccctgggattttcaggtgttttcatttggtgatcaggactgaacagagagaactcaccatggagtttgggctgagcgtggcgttttcttagtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaaggggctggagtgggtctctactattactgctagtggtaatcatgcatactatgcagactccgtgaagggccggttcaccttcaccagagacaattccaagaacacgctctatctgcaattgaccagcctgagcgccgaggacacggccatgtattactgtactaaatcgcgggtggcgcggccggtacctcggatggttttgntttctggggccaaggga

SEQ ID NO: 456715 - DNA, 464 bp, Homo sapiens
  misc_feature: HEFZJCU01CZ0NZ.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacggggggaaaattggggccagggaaccctggtctccgtctcgtcagcctccaccaagggcccatcggtcttccccctggcgccctgctccaggagcacctccgagagcacagcggccctgggctgcctggtcaaggctacttcccacgagagta

SEQ ID NO: 456716 - DNA, 526 bp, Homo sapiens
  misc_feature: HEFZJCU01EAQSN.12.86.H09.1.454.heavy.3.raw
  modified_base (380)..(380): a, c, t, g, unknown or other
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttcngtgcgagtcttgatagtagtggttatcctgaatactggggccagggaaccctggtgaccgtctcctcagcctccaccaagggccatcggtcttcccctgcgccctgctccaggagcacctccgagagcacagcggccctcgggtcg

SEQ ID NO: 456717 - DNA, 525 bp, Homo sapiens
  misc_feature: HEFZJCU01CYZU6.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttccccctggcgccctcgctccaggagcacctccg

SEQ ID NO: 456718 - DNA, 508 bp, Homo sapiens
  misc_feature: HEFZJCU01C8XCX.52.67.G01.1.454.heavy.3.raw
cgcagtacgacacgaccggtgctcgatttagagtatacatattgggtttggggacccaacaaccacatccctcctcagaacgccccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccagggcagagtcaccatcaccagggacacatccgcgagcacagcctacatggagttgagcagcctgagaaatgaagacacggctgtatattactgtgcgagaggggaaatggcctccaccagggcccatcggtctcccctgacaccctcctcc

SEQ ID NO: 456719 - DNA, 516 bp, Homo sapiens
  misc_feature: HEFZJCU01CHENP.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctggggccaggggacc

SEQ ID NO: 456720 - DNA, 479 bp, Homo sapiens; identical to SEQ ID NO: 450171
  misc_feature: HEFZJCU01CGWFR.14.70.G04.1.454.heavy.3.raw

SEQ ID NO: 456721 - DNA, 542 bp, Homo sapiens
  misc_feature: HEFZJCU01ESGS2.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagcgtggcttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaaggggctggagtgggtctctactattactgctagtggtaatcatgcatactatgcagactccgtgaagggccggttcaccttcaccagagacaattccaagaacacgctctatctgcaattgaccagcctgagcgccgagacgacggccatgtattactgtactaaatcgcgggtcggccgccggccggtacctcggtagttggttttagtagttttctgggggtacccgaagggaacg

SEQ ID NO: 456722 - DNA, 530 bp, Homo sapiens
  misc_feature: HEFZJCU01CUD63.4.59.F04.1.454.heavy.3.raw
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggccccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctccctgaggctgagctctgtgaccgccgcggacacggccgtgtatttctgtgcgagatctttcgattttggagtgtaaccccttggctactggggccagggaaccctggtcaccgtctcttcagcctccaccaagggcccacg

SEQ ID NO: 456723 - DNA, 530 bp, Homo sapiens
  misc_feature: HEFZJCU01AY8Z3.48.26.C04.1.454.heavy.3.raw
agtatacatacacgaccggtgctcgatttagtctagcgactttgggtttggggggaagaggaagactgacggtccccccaggagttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggtttactatggttcggggagtctccgacccagcaactggttcgaccctcggggccagggaaccctggtcaccgtcctcctcagcctccaccaagggcccatcggtcttccccctcggccaccctcctccaagagcacctctggggcacacg

SEQ ID NO: 456724 - DNA, 473 bp, Homo sapiens
  misc_feature: HEFZJCU01B40AS.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcggcccgtcgggcgtgcctggtcaaggactacttccctacagtgct

SEQ ID NO: 456725 - DNA, 519 bp, Homo sapiens
  misc_feature: HEFZJCU01C34RN.19.86.H09.1.454.heavy.3.raw
  modified_base (500)..(500): a, c, t, g, unknown or other
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacgggctaaaggcataaagtggttcgacccctggggccagggaaccctggtcaccgtctcctcagcctccaccaagggccatcggtcttcccctggcgccctgctccagagcacctccganagcacagcggccctgggcc

SEQ ID NO: 456726 - DNA, 477 bp, Homo sapiens
  misc_feature: HEFZJCU01A9UW0.51.6.A06.1.454.heavy.3.raw
cgatcgtatacacgaccggtgctcgatttagatctactgacagggggctgagctgggttttcctcgttgctcttttaagaggtgtccagtgtcaggtgcagctggtgcagtctgggggaggcgtggtccagcctgggaggtccctgagactctcctgtgaagcctctggattcagcttcagtacgtatggtttgcgctgggtccgccaggctccaggcaagggactgcagtgggtggcatctatatcatatgaaggaagcaataaatactacgcagactccgtgaagggccgattcaccatctccagagacaatcccaagaacacactttatctgcaaatgaacaccctgagacttgaggacacggctgtctattattgtgcgagagggagatcgatcacagcagccctcgaacgaccagcatgaatggtttgatgtctgggccagggacaatggtcaccgtctcttctacgcctcc

SEQ ID NO: 456727 - DNA, 499 bp, Homo sapiens
  misc_feature: HEFZJCU01D1XZC.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtcgacccctgactgataaaccggactggttcgacccctggggccgagggacctggtcaccgtctcct

SEQ ID NO: 456728 - DNA, 498 bp, Homo sapiens
  misc_feature: HEFZJCU01DS7BD.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttccccctggcgccctgctccaggagcacctctgggggcacagcggccctgggctgcctggtcaaggactacttcctacgtcgtat

SEQ ID NO: 456729 - DNA, 518 bp, Homo sapiens; identical to SEQ ID NO: 449255
  misc_feature: HEFZJCU01A6F4H.3.17.B06.1.454.heavy.3.raw

SEQ ID NO: 456730 - DNA, 422 bp, Homo sapiens; identical to SEQ ID NO: 444681
  misc_feature: HEFZJCU01BB8TZ.16.78.H01.1.454.heavy.3.raw

SEQ ID NO: 456731 - DNA, 512 bp, Homo sapiens
  misc_feature: HEFZJCU01EFK9J.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactgggggcccgggagcccctgggt

SEQ ID NO: 456732 - DNA, 497 bp, Homo sapiens
  misc_feature: HEFZJCU01BO055.14.25.C03.1.454.heavy.3.raw
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatgggaggtcgatattgta

SEQ ID NO: 456733 - DNA, 513 bp, Homo sapiens
  misc_feature: HEFZJCU01DU6EK.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtggggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccatctcctcagcctccaccaagggcccatcggtcttcccccgtggcgccctcgctccaggagcacctccgagagcacacgcggccctgggctgcctggtcaaggactacttccagacgtatca

SEQ ID NO: 456734 - DNA, 400 bp, Homo sapiens; identical to SEQ ID NO: 444452
  misc_feature: HEFZJCU01EIEHT.47.24.C02.1.454.heavy.3.raw

SEQ ID NO: 456735 - DNA, 488 bp, Homo sapiens; identical to SEQ ID NO: 445778
  misc_feature: HEFZJCU01CWC75.18.70.G04.1.454.heavy.3.raw

SEQ ID NO: 456736 - DNA, 515 bp, Homo sapiens
  misc_feature: HEFZJCU01CBFA5.16.2.A02.1.454.heavy.3.raw
tgtactactccacgaccggtgctcgatttagactcatctacagggggagagaggagccttagccctggattccaaggcctatccacttggtgatcagcactgaccaccgaggattcaccatggagctggggctccgctgggttttccttgttgctattttagaaggtgtccagagtgaggtgcagctggtggagtttgggggaggcctggtcaagcctggggggtccctgagactctcctgtgcagcctctgaattcatcttcagtatctataacatgaactgggtccgccagactccagggaagggctggagtgggtcgcatccattagtggtggtaataattacatatactacggagactcaatgaagggccgcttcaccatctccagagacaacgccgaaaactcactgtatctgcagatgaacagcctgagagccgaagacacggctgtgtattactgtgcgagaggtcttactatagtttcggggagttaatataacgacgtatttcgta

SEQ ID NO: 456737 - DNA, 504 bp, Homo sapiens
  misc_feature: HEFZJCU01EXXB9.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaaggcccatcggtcttcccctggcgccctgctccagga

SEQ ID NO: 456738 - DNA, 510 bp, Homo sapiens
  misc_feature: HEFZJCU01D9RK3.48.53.E09.1.454.heavy.3.raw
agtatacatacacgaccggtgctcgatttagagagagtgtgttgggtcgggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 456739 - DNA, 488 bp, Homo sapiens
  misc_feature: HEFZJCU01EJ4FL.10.55.E11.1.454.heavy.3.raw
catagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagatcgaagaaggtggctacaatcac

SEQ ID NO: 456740 - DNA, 524 bp, Homo sapiens; identical to SEQ ID NO: 445902
  misc_feature: HEFZJCU01EDXJH.9.78.H01.1.454.heavy.3.raw

SEQ ID NO: 456741 - DNA, 501 bp, Homo sapiens
  misc_feature: HEFZJCU01EK8PP.17.10.A10.1.454.heavy.3.raw
  modified_base (475)..(475): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacatttnataggctctatggactggacttcgtc

SEQ ID NO: 456742 - DNA, 529 bp, Homo sapiens
  misc_feature: HEFZJCU01ALREF.4.1.A01.1.454.heavy.3.raw
agcactgtagcacgaccggtgctcgatttagacgtctcatcaggggtcccaacaaccacatccctcctcagaagcccccagagcacaacacctcaccatggactggacctggaggatcctctttttggtggcagcagccacaggtgtccactcccaggtccaacttgtgcagtctgaggctgaggtgaagacgccaggggcctcagtcaagatttcctgtaaggcctctggatatacgttcattaactatgctatccattgggtgcgccaggcccccggacaaaacctgacgtggatgggttggatcaatggtgaaactggaaaaaccaaatattcaccgagcttccagggcagaatgaccatctcccgggacacatccgcgagcgcaatctatctggaactgagccgcctgacatctgcagactcggcagtatatttctgtgcgagaggaggggaggagttggttaggagggtaatttggttattccatacttactttgaccacgtcgggggccgacgggtaaccccg

SEQ ID NO: 456743 - DNA, 488 bp, Homo sapiens; identical to SEQ ID NO: 448226
  misc_feature: HEFZJCU01BBK9L.18.70.G04.1.454.heavy.3.raw

SEQ ID NO: 456744 - DNA, 526 bp, Homo sapiens
  misc_feature: HEFZJCU01D34RT.51.62.F07.1.454.heavy.3.raw
cgatcgtatacacgaccggtgctcgatttagtagtcgcataaagggaaaggggcatcacataacaaccagattcctcctctaaagaagcccctgggagcacagttcatcaccatggactggacctggaagttcctctttgtggtggcagcagcaacaggtgtccagtcgcaggtccagctggtgcagtctgggactgaggtgaagaggcctgggtcctcggtgaaggtctcctgcaaggcatctaaaaacatcttaagaagttatgacatcgcctgggtgcgacaggcccctggacatgggcttgagtgggtgggcaggatcatccctatgtttggagtcgcaaactacgcacagaagttccggggcaaagtcacgttgaccgcggacacagtcacggacacagccctacatggaactcaacggcctcagatttgaggacacggccgtctattattgtgcgagagtgagaaattacggtggctactcccttgactactggggccaggggaaccctgggtctacccg

SEQ ID NO: 456745 - DNA, 537 bp, Homo sapiens
  misc_feature: HEFZJCU01B1ESZ.52.55.E11.1.454.heavy.3.raw
  modified_base (457)..(457): a, c, t, g, unknown or other
cgcagtacgacacgaccggtgctcgatttagcactcgcacgttgggtttggggaaccagattcctcctctaaagaagcccctgggagcacagctcatcaccatggactggacctggaggttcctctttgtggtggctgcagttacagctgtccagtcccaggtccacctggtgcagtctggggctgaagtaaagaagcctgggtcgtcggtgaaggtctcctgcagggcctctggagccaccttcggcacttatgggatcagctgggtgcgccaggcccctggacaagggcttgagtggatgggaagggtcatccctttctttgatttaacgaactacgcacagaaattccagggcagagtcaccattaccgcggacgaatccacgaccacagcctacatggagctgcgcaacctaagatctgacgacacggccgtgttttactgtgcgagatttanagtctcgcccaccaacttctggtggcggcggtgttccaccttactactttgactcctggggccaggggaaccctggtccg

SEQ ID NO: 456746 - DNA, 506 bp, Homo sapiens; identical to SEQ ID NO: 444696
  misc_feature: HEFZJCU01BQ28D.16.34.D01.1.454.heavy.3.raw

SEQ ID NO: 456747 - DNA, 498 bp, Homo sapiens
  misc_feature: HEFZJCU01CJU6S.53.1.A01.1.454.heavy.3.raw
cgcgtatacacacgaccggtgctcgatttagacgtctcatcagggggcatcacataacaaccagattcctcctctaaagaagcccctgggagcacagctcatcaccatggactggacctggaggttcctctttgtggtggcagcagctaccggtgtccagtcccaggtccacctggtgcaatccgggactgaggtgaagaagcctgggtcctcggtgaaggtctcctgcaaggcctctggagacaccttcaacagttatggtatcagttgggtgcgacaggcccctggacaagggcttgagtggatgggaaggatcatcccaatccttggtattacaaaaatgcacagaggtttcagggcagagtcctgttaaccgcggacaaatccactaccacagtctacatggagctgagcagcctgagatctgaagacacggccctgtactattgtgcgagagaaatgtacttctatgacagtactaatcaatatgcttttgat

SEQ ID NO: 456748 - DNA, 479 bp, Homo sapiens; identical to SEQ ID NO: 447128
  misc_feature: HEFZJCU01C8TQ9.4.37.D04.1.454.heavy.3.raw

SEQ ID NO: 456749 - DNA, 514 bp, Homo sapiens
  misc_feature: HEFZJCU01A02Z7.17.33.C11.1.454.heavy.3.raw
  modified_base (417)..(417): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactnttcacgctctatggttcggggagttattagtccctactttgactacgtggggccagggactctggtccaccgtctccgcagcctccacaacgggccc

SEQ ID NO: 456750 - DNA, 503 bp, Homo sapiens
  misc_feature: HEFZJCU01C3FXZ.51.82.H05.1.454.heavy.3.raw
cgatcgtatacacgaccggtgctcgatttagtcgagctctctcgcgggggctctgggagaggagcccagccctagaagtcggcggtgtttccattcggtgatcagcactgaacacagaggactcaccatggagtttgggctgagctgggttttcctcgttgctcttttaagaggtgtccagtgtcaagtgcaactggtggagtctgggggaggcgtggtccagcctgggaggtccctgagactctcctgcgtggcctctggattcaccttcaatagttatggcatgctctgggtccgccaggccccaggcagggggctggactgggtagcatctatatcgtacgatggagctgacgaatacctcgcagactccgtgaagggccgattcaccatctcaagagacaattccaagaacaccctgtttctgcaaatgaacagcctgagacctgcggacacggctatgtatttctgtgcgaaggttactgggacctactctggtcccg

SEQ ID NO: 456751 - DNA, 410 bp, Homo sapiens; identical to SEQ ID NO: 451498
  misc_feature: HEFZJCU01DM9VC.13.61.F06.1.454.heavy.3.raw

SEQ ID NO: 456752 - DNA, 532 bp, Homo sapiens
  misc_feature: HEFZJCU01CW1LE.19.48.E04.1.454.heavy.3.raw
tactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgccaggctccggggaaggggccggagtgggtggccaacataatgcaagatggaactgagaaaaactatggggactctgtgaagggccgattcaccatctccagagacaaccgtaagaacttactgtttctgcaaatgaacagcctgagagccgaggacacggctgtgtattatgtgcgaagggcagtggctgggacagtggacgtcgtggggccaagggaccacggtcaccgt

SEQ ID NO: 456753 - DNA, 537 bp, Homo sapiens
  misc_feature: HEFZJCU01B678R.40.27.C05.1.454.heavy.3.raw
tctagcgactcacgaccggtgctcgatttagacgcgatcgaagggttggggggaagaggaagactgacggtcctgtcccagttgcagttgcaggagtcgggcccaggactggtgaagacttcggagaccctgtccctcacgtgcactgtctctggtggctccatccgcaatcgtcgattctattggggctgggtccgccggcccccagggaaggggctggagtggattgcgagcatatattatgatgagagcgccctctacaaccccccctctacaacccctccctcaagagtcgggtcaccatatctatagacacgtccaacagtcaattctccctggacttgacctctgtgaccgccgcagacacggctgtatattcctgtgcgacccacggagggatggccccaaatctgcctactttgaccactggggccagggaaccttggtcaccgtctcctcagcctccaccaagggcccatcggtcttcccctggccgccctgcctccaggagcacctccgagacgcacagccggccct

SEQ ID NO: 456754 - DNA, 496 bp, Homo sapiens
  misc_feature: HEFZJCU01D3KY6.4.26.C04.1.454.heavy.3.raw
agcactgtagcacgaccggtgctcgatttagtctagcgactttgggtttggggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatctccagagacaattccaagaacacgttatatctgcaaatgaacagcctgcgagccgacgacacggccgtatattactgtgcgaaatgccttattgcgaccgagcgtagcagtggctggtgcaactggctcgacccctggggccagggaacccatgtcaccgtctcctcagcctccaccaagggcccatcggtcttcccctggcgccctgctccaggagcacctccgagaacacagcggccctgggctgcctggtcaaggactactccctacagtgct

SEQ ID NO: 456755 - DNA, 515 bp, Homo sapiens
  misc_feature: HEFZJCU01ELUWG.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgagggccgattcaccatctccagagacaattccaagaacacgctgtttcttcaaatgaacagcctgagagccgatgacacggccgtgtattactgtgcgagagagtggggcccacgaacgttactacgctatggacgtcgtggggtaccg

SEQ ID NO: 456756 - DNA, 511 bp, Homo sapiens; identical to SEQ ID NO: 445268
  misc_feature: HEFZJCU01B5KFD.48.34.D01.1.454.heavy.3.raw

SEQ ID NO: 456757 - DNA, 496 bp, Homo sapiens; identical to SEQ ID NO: 446915
  misc_feature: HEFZJCU01B490P.3.26.C04.1.454.heavy.3.raw

SEQ ID NO: 456758 - DNA, 481 bp, Homo sapiens
  misc_feature: HEFZJCU01EG4RF.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggactactccgtatctctcg

SEQ ID NO: 456759 - DNA, 508 bp, Homo sapiens
  misc_feature: HEFZJCU01DBT0E.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcactctgggggcacagcggccctgggctgcctggtcaaggactacttcctacgtcgtat

SEQ ID NO: 456760 - DNA, 523 bp, Homo sapiens
  misc_feature: HEFZJCU01EREDP.52.35.D02.1.454.heavy.3.raw
cgcagtacgacacgaccggtgctcgatttagcacacgatagttgggtttggggacataacaaccagattcctcctctaaagaagcccctgggagcacagctcatcaccatggactggacctggaggttcctctttgtggtggctgcagttacagctgtccagtcccaggtccacctggtgcagtctggggctgaagtaagaagcctgggtcgtcggtgaaggtctcctgcagggcctctggagccaccttcggcacttatgggatcagctgggtgcgccaggcccctggacaagggcttgagtggatgggaagggtcatccctttctttgatttaacgaactacgcacagaaattccagggcagagtcaccattaccgcggacgaatccacgaccacagcctacatggagctgcgcaacctaagatctgacgacacggccgtgtttactgtgcgagattacagtctcgccacaacttctggtggcggcggtgttccaccttactactttgactcctgggccac

SEQ ID NO: 456761 - DNA, 489 bp, Homo sapiens; identical to SEQ ID NO: 445620
  misc_feature: HEFZJCU01CYDDL.47.85.H08.1.454.heavy.3.raw

SEQ ID NO: 456762 - DNA, 486 bp, Homo sapiens
  misc_feature: HEFZJCU01C406O.10.85.H08.1.454.heavy.3.raw
catagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttcccctggcgccctgctccaggagcacctccgagagcacagcggccctgggctgcctggtcaaggactactcccactactatg

SEQ ID NO: 456763 - DNA, 510 bp, Homo sapiens
  misc_feature: HEFZJCU01E1R9M.48.24.C02.1.454.heavy.3.raw
agtatacatacacgaccggtgctcgatttagtacagatcgttagggaaaggggtctgagagaggagcccagccctgggattctcaggtgttttcatttggtgatcaggactgaacagagagaactcaccatggagtttgggctgagcgtggcttttcttagtggctattttaaaaggtgtccagtgtgaggtgcacctgttggagtctgggggaggcttggtacagcctggggggtccctgagactctcctgtgcagcctctggattcacctttagcagctatgccatgagctgggtccgccaggctccagggacggggctggagtgggtctcagctattagtggtagtggtggtggcacatactacgcagactccgtgaagggccggttcaccatctccagagacaattccaagaacacactttatctgcgaatgaacagcctgagagccgaggacacggccgtatattactgtgcgaaagaagtcagggttactatgatatcgggagg

SEQ ID NO: 456764 - DNA, 464 bp, Homo sapiens
  misc_feature: HEFZJCU01DVTQZ.5.86.H09.1.454.heavy.3.raw
atcagacacgcacgaccggtgctcgatttagtgctatagacttgggtttgggtccctgagactctcctgtgcagcctctggattcacctttactgattttggcatgacgtgggtccgccaggctccagggaaggggctggactggctctcaaatattaatggtaaaggcaatatacaagactacacagactccgtgaagggccggttcaccacctcgagagacaactccagggacacggtgtacctacacatgaacagcctgagagccgaggacacggccgtatattattgtgtgaggggaaactgggggcaatttgaccgctggggccagggaaccctggtcaccgtctcctcagcctccaccaagggcccatcggtcttccccctggcgccctgctccaggagcacctccgagagcacagcggccctgggctgcctggtcaaggactactcccgtgtctgat

SEQ ID NO: 456765 - DNA, 519 bp, Homo sapiens; identical to SEQ ID NO: 446650
  misc_feature: HEFZJCU01B7G11.13.76.G10.1.454.heavy.3.raw

SEQ ID NO: 456766 - DNA, 520 bp, Homo sapiens
  misc_feature: HEFZJCU01EP6EF.15.28.C06.1.454.heavy.3.raw
tctacgtagccacgaccggtgctcgatttagagctcacgtattgggtttggggggaagaggaagactgaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccac

SEQ ID NO: 456767 - DNA, 496 bp, Homo sapiens
  misc_feature: HEFZJCU01EL1NS.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagcgtggttttcgtcgttaggctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagccctgagaactgacgacacgtctctctactactgtgcgagagagttgacgagtct

SEQ ID NO: 456768 - DNA, 391 bp, Homo sapiens
  misc_feature: HEFZJCU01BK07V.16.72.G06.1.454.heavy.3.raw
tgtactactccacgaccggtgctcgatttagctacgactgcaagggaaaggggctggagtgggtctcatctattagtagtagtgatagtgccacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctggcgccctgctccaggagcacctccgagagcacagcggccctgggctgcctggtcaaggactacttccgagtagtaca

SEQ ID NO: 456769 - DNA, 519 bp, Homo sapiens; identical to SEQ ID NO: 445330
  misc_feature: HEFZJCU01AOTKT.7.78.H01.1.454.heavy.3.raw

SEQ ID NO: 456770 - DNA, 324 bp, Homo sapiens; identical to SEQ ID NO: 444475
  misc_feature: HEFZJCU01EDKAE.18.17.B06.1.454.heavy.3.raw

SEQ ID NO: 456771 - DNA, 501 bp, Homo sapiens; identical to SEQ ID NO: 447719
  misc_feature: HEFZJCU01AFXG4.17.10.A10.1.454.heavy.3.raw

SEQ ID NO: 456772 - DNA, 483 bp, Homo sapiens; identical to SEQ ID NO: 444924
  misc_feature: HEFZJCU01BQ8EH.10.35.D02.1.454.heavy.3.raw

SEQ ID NO: 456773 - DNA, 530 bp, Homo sapiens
  misc_feature: HEFZJCU01CALBZ.52.78.H01.1.454.heavy.3.raw
cgcagtacgacacgaccggtgctcgatttagtgtgagtagtttgggtttggggatgctttctgagagtcatggacctcctgtgcaagaacatgaagcacctgtggttcttcctcctgctggtggcggctcccagatgggtcctgtcccagctgcagctgcaagagtcgggcccacgactggtgaagcctgcggagcccctgtccctcacctgcactgtctctggtgactccatcaccaataatgattactactgggcctggatccgccagcccccagggaaggggctggagtggattggcagtatattttatactggaaatacctaccaaaacccgtccctcaacagccgactcaccatttcagtggacacgtccaagaaccagttctccctgaaactgagctctgtgaccgccgcagacacggccatttattactgtgcgggagaggagcgacaagactggagttcccgggagcgtggttcggctccgtggggccacgggggaccccgggtcgacccgtctccctcacg

SEQ ID NO: 456774 - DNA, 497 bp, Homo sapiens; identical to SEQ ID NO: 444995
  misc_feature: HEFZJCU01BGFL2.4.26.C04.1.454.heavy.3.raw

SEQ ID NO: 456775 - DNA, 523 bp, Homo sapiens
  misc_feature: HEFZJCU01DGFGL.49.53.E09.1.454.heavy.3.raw
  modified_base (462)..(462): a, c, t, g, unknown or other
agtcgagagacacgaccggtgctcgatttagagagagtgtgttgggtttggggggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtatttggatattacgcagagtccgtaaagggccgattcaccatctccagagacaattcgaagaacaccatgtatctggaactgagcagagtcacatctgaggacacggctatntattactgtgtgaaagtacttttatgacagtagtggtttctccgtagtatgcacattacgg

SEQ ID NO: 456776 - DNA, 429 bp, Homo sapiens; identical to SEQ ID NO: 447944
  misc_feature: HEFZJCU01BYS5R.4.37.D04.1.454.heavy.3.raw

SEQ ID NO: 456777 - DNA, 524 bp, Homo sapiens; identical to SEQ ID NO: 445728
  misc_feature: HEFZJCU01EDPVY.5.33.C11.1.454.heavy.3.raw

SEQ ID NO: 456778 - DNA, 510 bp, Homo sapiens
  misc_feature: HEFZJCU01ECURO.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcgttttcttagtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaagggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagtatctcgggctggttccgcggtccgggt

SEQ ID NO: 456779 - DNA, 503 bp, Homo sapiens; identical to SEQ ID NO: 445995
  misc_feature: HEFZJCU01D6FWD.17.25.C03.1.454.heavy.3.raw

SEQ ID NO: 456780 - DNA, 399 bp, Homo sapiens; identical to SEQ ID NO: 444537
  misc_feature: HEFZJCU01B7N87.16.29.C07.1.454.heavy.3.raw

SEQ ID NO: 456781 - DNA, 512 bp, Homo sapiens
  misc_feature: HEFZJCU01C8R6C.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccggggaggctgggtccagcctgggggtccctgagactctcctgttcagcctctggattcacctttagtaggttttggatgagttgggtccgccaggctccagggaagggctggagtgggtggccaacatagagtacgatggaagtgagaaaactatgtggactccgtgaagggccgattcacatctccagagacaacgacaagaatttagtgtatctgcaaatgagcagcctgagagccgaggacacggctgtgtattattgtg

SEQ ID NO: 456782 - DNA, 508 bp, Homo sapiens
  misc_feature: HEFZJCU01AGXKP.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacacgcggccctgggctgcctggtcaagactacttccagacgtatca

SEQ ID NO: 456783 - DNA, 521 bp, Homo sapiens
  misc_feature: HEFZJCU01BQF47.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttctcaaatgaacagcctgagagccgatgacacggccgtgtattactgtgcgagagatcggggcccacgaacgttactacgctagtggacgtcgtggggccaagggaccg

SEQ ID NO: 456784 - DNA, 491 bp, Homo sapiens; identical to SEQ ID NO: 444749
  misc_feature: HEFZJCU01D06AX.11.13.B02.1.454.heavy.3.raw

SEQ ID NO: 456785 - DNA, 470 bp, Homo sapiens; identical to SEQ ID NO: 444866
  misc_feature: HEFZJCU01DPB0Q.4.36.D03.1.454.heavy.3.raw

SEQ ID NO: 456786 - DNA, 527 bp, Homo sapiens
  misc_feature: HEFZJCU01DXALL.14.35.D02.1.454.heavy.3.raw
cgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactggggccagggaaccctggtcaccgtctcctcagcctccaccaagggcccatcggtcttcccctggcaccctcctccaagagcacctctgggggcacagcggcctgggctgcctggtcaaggactacttccg

SEQ ID NO: 456787 - DNA, 520 bp, Homo sapiens; identical to SEQ ID NO: 453029
  misc_feature: HEFZJCU01DYM7W.16.86.H09.1.454.heavy.3.raw

SEQ ID NO: 456788 - DNA, 527 bp, Homo sapiens
  misc_feature: HEFZJCU01DBFH3.11.25.C03.1.454.heavy.3.raw
cgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaatgaacagcctgagagccgatgacacggccgtgtattactgtgcgagagatggggcccacgaacgttactacgctatggacgtctggggccaagggaccacc

SEQ ID NO: 456789 - DNA, 533 bp, Homo sapiens
  misc_feature: HEFZJCU01BIAYG.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccagggagccctggtcaccggt

SEQ ID NO: 456790 - DNA, 495 bp, Homo sapiens; identical to SEQ ID NO: 445359
  misc_feature: HEFZJCU01CL7DL.4.21.B10.1.454.heavy.3.raw

SEQ ID NO: 456791 - DNA, 461 bp, Homo sapiens; identical to SEQ ID NO: 450352
  misc_feature: HEFZJCU01BUDW2.4.6.A06.1.454.heavy.3.raw

SEQ ID NO: 456792 - DNA, 494 bp, Homo sapiens
  misc_feature: HEFZJCU01EQXIY.12.2.A02.1.454.heavy.3.raw
atacgacgtacacgaccggtgctcgatttagactcatctacaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcaccatgaccacagacacatccacgagcacagcctacatggagctgaggagcctgagatctgacgacacggccgtgtattactgtgcgagaggttttagtgatacttattgtagtggtggtacctgctactttt

SEQ ID NO: 456793 - DNA, 530 bp, Homo sapiens
  misc_feature: HEFZJCU01AJVW5.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaacgggcccatcggtcttccccctcggcgccctgctccagagcacctccgagagcacagcggcccgtcgggtcg

SEQ ID NO: 456794 - DNA, 517 bp, Homo sapiens
  misc_feature: HEFZJCU01AH1WB.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaagggaggggggaaccaggcgggagttccaagtactcctttgacgtctggggcc

SEQ ID NO: 456795 - DNA, 526 bp, Homo sapiens
  misc_feature: HEFZJCU01CNG2Y.40.16.B05.1.454.heavy.3.raw
tctagcgactcacgaccggtgctcgatttagagctcacgtaagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgcccgccgggcagggactggagtggattgggcgcgtctatcacagtgaaaccagctacatcccctccctcgagagtcgagtcaccatttcactagacacgtccacaaatcagttgtccctgaggctgagctctgtgaccgccgcggacacgggcgtatattactgtgcgagagggggccgggggaaactcctatggctcctttgactactggggccaggggaaccctggtcaccgtctcctcagcctccaccaagggcccatcggtcttcccctggcgccctgctccaggagcaccc

SEQ ID NO: 456796 - DNA, 490 bp, Homo sapiens
  misc_feature: HEFZJCU01A62NG.40.85.H08.1.454.heavy.3.raw
tctagcgactcacgaccggtgctcgatttagtatcactcagtcgcggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcgggactgacctctgacgacacggccatgtattactgtggaagagacgttggtggctaccgcggggctgaccactggggccagggaaccctggtcaccgtctcctcagcctccaccaagggcccatcggtcttcccctggcgcctgctccaggagcacctccgagagcacagcggccctgggctgcctggtcaaggactacttccagtcgctaga

SEQ ID NO: 456797 - DNA, 481 bp, Homo sapiens
  misc_feature: HEFZJCU01BEEZ5.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgtcggccgactactggggccagggcaccctggtcaccgtctcttcagcctccaccaagggcccatcggtcttcccctggcgccctgctccaggagcacctccgagagcacagcggccctgggctgcctggtcaaggactacttccagacgtatca

SEQ ID NO: 456798 - DNA, 521 bp, Homo sapiens
  misc_feature: HEFZJCU01DKLKQ.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtccttccccctggcaccctcctccaagagcacctctgggggcacagcggccctgggctgcctggtcaaggactacttccgagtagtacac

SEQ ID NO: 456799 - DNA, 527 bp, Homo sapiens
  misc_feature: HEFZJCU01BTUW9.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgacttctgggccatggaacccggtccg

SEQ ID NO: 456800 - DNA, 495 bp, Homo sapiens
  misc_feature: HEFZJCU01BMBVY.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggcttggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgcctgctcaggagcacctctgggggcacagcggccctgggctgcctggtcaaggactacttctacgtcgtat

SEQ ID NO: 456801 - DNA, 509 bp, Homo sapiens
  misc_feature: HEFZJCU01DJ4QP.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgtttcgatgccttcggtccgcgggacttctggggccagggaacctc

SEQ ID NO: 456802 - DNA, 381 bp, Homo sapiens; identical to SEQ ID NO: 444427
  misc_feature: HEFZJCU01BZBZ6.9.53.E09.1.454.heavy.3.raw

SEQ ID NO: 456803 - DNA, 512 bp, Homo sapiens
  misc_feature: HEFZJCU01EW68H.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaaggggaccacggtcaccgtctcctcacgcctccaccgaagggcccatcc

SEQ ID NO: 456804 - DNA, 526 bp, Homo sapiens
  misc_feature: HEFZJCU01AKG6U.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaagggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcgggggacctcaccctggttcctacgttcgatctcgtcggggcc

SEQ ID NO: 456805 - DNA, 465 bp, Homo sapiens; identical to SEQ ID NO: 444805
  misc_feature: HEFZJCU01BQ8Z9.19.10.A10.1.454.heavy.3.raw

SEQ ID NO: 456806 - DNA, 477 bp, Homo sapiens; identical to SEQ ID NO: 444659
  misc_feature: HEFZJCU01B1AFD.16.10.A10.1.454.heavy.3.raw

SEQ ID NO: 456807 - DNA, 511 bp, Homo sapiens
  misc_feature: HEFZJCU01ADWG6.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattacttgtacgaaagaggggggatacgagtggcaggctaccaacgtactta

SEQ ID NO: 456808 - DNA, 499 bp, Homo sapiens
  misc_feature: HEFZJCU01C8WSF.16.37.D04.1.454.heavy.3.raw
tgtactactccacgaccggtgctcgatttagtagcatactgtgggtttgggggagacttagtacagccgggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 456809 - DNA, 418 bp, Homo sapiens
  misc_feature: HEFZJCU01CXRM8.40.20.B09.1.454.heavy.3.raw
tctagcgactcacgaccggtgctcgatttagtgtagtgtgaagggactggagtggattgcggctatttcttatagtgagaacacctactacaacccgtccctcaagagtcgagtcaccatatccgtagacacgtccaacaaccagttctccctgaacctgagccctgtgaccgtcgcagacacggctgtatattattgtgggagacgctttcgtgacttaggccctgactacggtcggcccccataccgaggacgatttcctcggtatggacgtctggggccaagggaccacggttaccgtctcctcagcctccaccaagggcccatcggtcttccccctggcgccctgctccaggagcacctccgagagcacagcggccctgggctgcctggtcaaggactacttccagtcgctaga

SEQ ID NO: 456810 - DNA, 552 bp, Homo sapiens
  misc_feature: HEFZJCU01BGO2Y.22.34.D01.1.454.heavy.3.raw
acatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcacgcccccagggaagggactggagtggattggctatatttcttacagtggccgcaccaactcccacccctccctcaagagtcgagccaccatatcagtcgacacgtccaagaaccagttctccctgaaactgaggtctgtgaccgcagcggacacggccgtgtattactgtgcgagagagtccgggtccgatatctggccgttcgacccctgggccgagggaaccctggtcaccgtctcctcagcctccaccaagggcccatcggtcttccccctggccgccctgctccaggagcaccctccgagagccacgagccggcccgtgggcctcgcctggtcaagggacctaccttccacc

SEQ ID NO: 456811 - DNA, 502 bp, Homo sapiens
  misc_feature: HEFZJCU01DI2GX.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccagatccggtgagcctacggcagcggcctttgacttctc

SEQ ID NO: 456812 - DNA, 514 bp, Homo sapiens
  misc_feature: HEFZJCU01DGWUT.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaaggcccatcgtcttcccctgcaccctcctccaagagcacctctgggggcacagcggccctgggctgcctggtcaaggactacttccagacgtatca

SEQ ID NO: 456813 - DNA, 504 bp, Homo sapiens
  misc_feature: HEFZJCU01BCAWU.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgttcatctgaaggagtgttcaatactatacagactccgtgaagggccgattcaccatctccagagacaattccaagaacacgatgtatctgcaaatggacagcctaagagttgaggacacggctgtttattactgtacgaagaggggggatacagtggcagctccaagtacttac

SEQ ID NO: 456814 - DNA, 500 bp, Homo sapiens; identical to SEQ ID NO: 445028
  misc_feature: HEFZJCU01B1LFA.13.12.B01.1.454.heavy.3.raw

SEQ ID NO: 456815 - DNA, 531 bp, Homo sapiens; identical to SEQ ID NO: 446857
  misc_feature: HEFZJCU01EZ0H5.7.78.H01.1.454.heavy.3.raw

SEQ ID NO: 456816 - DNA, 488 bp, Homo sapiens
  misc_feature: HEFZJCU01E0SJR.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactcctgtatctgcaaatgaacagtctgagagctgaggacacggccttgtattactgtgcaaggaggtatagcagctactggtacgactactggggccagggaaccctggtcaccgtctcctcagcctccaccaaggccatcggtcttcccctggcgccctgctccaggagcacctccgagagcacagcggccctgggctgcctggtcaaggactacttcccacgagagta

SEQ ID NO: 456817 - DNA, 378 bp, Homo sapiens
  misc_feature: HEFZJCU01BZF7T.47.46.E02.1.454.heavy.3.raw
agctcacgtacacgaccggtgctcgatttagactcatctacagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcaccctcctccaagagcacctctgggggcacagcggccctgggctgcctggtcaaggactacttcctacgtgagct

SEQ ID NO: 456818 - DNA, 506 bp, Homo sapiens
  misc_feature: HEFZJCU01D56EU.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaaggggactgacatctgacgacacggccatgtattattgtgcgagagaaatgttaggtactgctttgggtcctggggcccgggaacccgggtc

SEQ ID NO: 456819 - DNA, 511 bp, Homo sapiens; identical to SEQ ID NO: 451090
  misc_feature: HEFZJCU01D2AZQ.12.78.H01.1.454.heavy.3.raw

SEQ ID NO: 456820 - DNA, 518 bp, Homo sapiens
  misc_feature: HEFZJCU01CA5WG.19.67.G01.1.454.heavy.3.raw
tactctcgtgcacgaccggtgctcgatttagagtatacatattgggtttggggtctgggagaggagcccagcactgggattccgaggtgtttccattcggtgctcagcactgaacacagaggactcaccatggagttttggctgacctgggttttccttgctgcaattttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggttatttttatagggtgggacgacattctacggagactccatggagggccgattcaccatcctccagagacttttctcagaacacactgtctcttcaaatgaacagcctgagggccgagggacacggccgtctattattggtgtgaggtagttttatgggcgatggctgggtgggacaggatc

SEQ ID NO: 456821 - DNA, 496 bp, Homo sapiens; identical to SEQ ID NO: 450059
  misc_feature: HEFZJCU01CXQM2.12.55.E11.1.454.heavy.3.raw

SEQ ID NO: 456822 - DNA, 522 bp, Homo sapiens
  misc_feature: HEFZJCU01DEJK5.10.53.E09.1.454.heavy.3.raw
catagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagaaactccgttcggggccgattcaccatctccaaagacaatttgaagaacacgctgtttctgcaaatgaacagcctgagagctgaggacacggctgtgtattactgttcgtttggttctgactcgtcggggaagtaccttcagcactggggccgagggccg

SEQ ID NO: 456823 - DNA, 511 bp, Homo sapiens; identical to SEQ ID NO: 448280
  misc_feature: HEFZJCU01AML5R.16.71.G05.1.454.heavy.3.raw

SEQ ID NO: 456824 - DNA, 508 bp, Homo sapiens
  misc_feature: HEFZJCU01C5PZN.53.52.E08.1.454.heavy.3.raw
cgcgtatacacacgaccggtgctcgatttagtcgagctctcagagagaaagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagttggtggagtccgggggaggcgtggtccagcctgggaggtccctgagactctcctgtgtagcctctggattcaccttcagggtctatggcatgaactgggtccgccagactccaggcaaggggctggagtgggtggcatttatatcatttgatggcactaataaatactatgcagactccgtgaggggccgattcaccatctccagagacaattccaagaagatggtgtttctgcaaatgaacagcctgagagttgaagacacggctgtgtattactgtgcgaacggaatggagtgggaactaggggtcg

SEQ ID NO: 456825 - DNA, 395 bp, Homo sapiens
  misc_feature: HEFZJCU01CYLUS.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacgacggccgtatatttctgtgcgaaagtctatagcagtgccccctagcgcacttctttgacttctgggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 456826 - DNA, 427 bp, Homo sapiens; identical to SEQ ID NO: 453768
  misc_feature: HEFZJCU01ALQOC.9.34.D01.1.454.heavy.3.raw

SEQ ID NO: 456827 - DNA, 454 bp, Homo sapiens
  misc_feature: HEFZJCU01A76RG.52.34.D01.1.454.heavy.3.raw
cgcagtacgacacgaccggtgctcgatttagatcgtctgtgttgggtttgggattcaccttaaataactacggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttccccctggcaccctcctccaagagcacctctgggggcacagcggccctgggctgcctggtcaaggactacttcctatacgatcg

SEQ ID NO: 456828 - DNA, 525 bp, Homo sapiens
  misc_feature: HEFZJCU01BQXD7.48.66.F11.1.454.heavy.3.raw
agtatacatacacgaccggtgctcgatttagtcacgcgagaagggggagccccagccctgggattcccagctgtttctgcttgctgatcaggactgcacacagagaactcaccatggagtttgggctgagctgggttttccttgttgctattttaaaaggtatccagtgtgaggagcagctggtggagtccggcggaggcttagttcagccgggggggtccctgagactctcctgtgtggcctctggattcacaattaatccatattggatcctctgggtccgccaagttccagggaaggggctggtttgggtctcacgtatttatgctgctggagatacagcctacgcggactccgtgaagggccgattcaccatctctagagacaacgccaagaacacggtgactctgcaaatggacggtctgagggccgacgacacggctgtctactattgtgcaaaagggccgattaactcttacggtctggacgtctggggccaagggaccacggtcagcgtctcttcag

SEQ ID NO: 456829 - DNA, 396 bp, Homo sapiens; identical to SEQ ID NO: 444469
  misc_feature: HEFZJCU01CHHNT.47.46.E02.1.454.heavy.3.raw

SEQ ID NO: 456830 - DNA, 518 bp, Homo sapiens; identical to SEQ ID NO: 446943
  misc_feature: HEFZJCU01CSWAI.7.78.H01.1.454.heavy.3.raw

SEQ ID NO: 456831 - DNA, 485 bp, Homo sapiens
  misc_feature: HEFZJCU01C12Q1.19.13.B02.1.454.heavy.3.raw
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcggaggcggt

SEQ ID NO: 456832 - DNA, 522 bp, Homo sapiens
  misc_feature: HEFZJCU01AIML8.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggcctgggctgcctggtcaaggactactcc

SEQ ID NO: 456833 - DNA, 396 bp, Homo sapiens; identical to SEQ ID NO: 444469
  misc_feature: HEFZJCU01EORZ7.47.46.E02.1.454.heavy.3.raw

SEQ ID NO: 456834 - DNA, 524 bp, Homo sapiens
  misc_feature: HEFZJCU01C43G2.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgttttattttgtacgagagcgtcgtctgtcagtggaattgactactggggccagggaaccctggtcaccgtctcctcagcctccaccaacggcccatcggtcttcccctggccaccctcctccaagacgcacctctgggggccacacgcggccctgggcctgcctggtcaaggactacttcctagagacacg

SEQ ID NO: 456835 - DNA, 513 bp, Homo sapiens
  misc_feature: HEFZJCU01BVJUB.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaataccgaggacacagccgtctattactgtgttagggtagttttacggtatttttggta

SEQ ID NO: 456836 - DNA, 521 bp, Homo sapiens
  misc_feature: HEFZJCU01EYVPB.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagaggccatggcttatgctgggacaacagaatacgccgcgtctgtgaaaggcagattcatcatctcaagagatgattccaacggcatcgcctatctgcagatgaacagcctgaagaccgaggacacagccgtctattactgttgttaggggtagttttacgtagttttggtaggtggatattaa

SEQ ID NO: 456837 - DNA, 518 bp, Homo sapiens
  misc_feature: HEFZJCU01C0N0Z.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttcccctcggcaccctcctccaagagcacctctgggggcacagcggccctgggctgcctggtcaaggactacttccagacgtatca

SEQ ID NO: 456838 - DNA, 464 bp, Homo sapiens
  misc_feature: HEFZJCU01EWF71.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccggggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaaattggggccagggaaccctggtctccgtctcgtcagcctccaccaagggcccatcggtcttccccctggcgccctgctccaggagcacctccgagagcacagcggcctgggctgcctggtcaaggactacttcccacgagagta

SEQ ID NO: 456839 - DNA, 437 bp, Homo sapiens; identical to SEQ ID NO: 444603
  misc_feature: HEFZJCU01BCRQC.3.21.B10.1.454.heavy.3.raw

SEQ ID NO: 456840 - DNA, 310 bp, Homo sapiens
  misc_feature: HEFZJCU01A6SAB.49.28.C06.1.454.heavy.3.raw
agtcgagagacacgaccggtgctcgatttagagctcacgtattgggtttggggggaagaggaagactgacggtcctcccaggagttcaggtgctgggcaccgtgggcatgggggaggtgtgtcacaagatttgggctctgggcaccgtgggcatgggggaggtgtgtcacaagatttgagccctggtcaccgtctcctcagcttccaccaagggcccatcggtcttccccctggcgccctgctccaggagcacctctgggggcacagcggccctgggctgcctggtcaaggactacttcctctctcgact

SEQ ID NO: 456841 - DNA, 483 bp, Homo sapiens
  misc_feature: HEFZJCU01E0YLW.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctcggcaccctcctccaagagcacctctgggggcacagcggcctgggctgcctggtcaaggactacttcctagagacacg

SEQ ID NO: 456842 - DNA, 537 bp, Homo sapiens; identical to SEQ ID NO: 445697
  misc_feature: HEFZJCU01B0Q7Z.14.57.F02.1.454.heavy.3.raw

SEQ ID NO: 456843 - DNA, 399 bp, Homo sapiens; identical to SEQ ID NO: 444537
  misc_feature: HEFZJCU01DSTX4.16.29.C07.1.454.heavy.3.raw

SEQ ID NO: 456844 - DNA, 489 bp, Homo sapiens
  misc_feature: HEFZJCU01BZGFE.10.55.E11.1.454.heavy.3.raw
  modified_base (484)..(484): a, c, t, g, unknown or other
catagtagtgcacgaccggtgctcgatttagcactcgcacgttgggtttggggagcatcatccaacaaccacatcccttctctacagaagcctctgagaggaaagttcctcaccatggactggacctggagggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaattggctgcgacaggcccctgggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggctanatcac

SEQ ID NO: 456845 - DNA, 483 bp, Homo sapiens; identical to SEQ ID NO: 452427
  misc_feature: HEFZJCU01CK6KV.49.27.C05.1.454.heavy.3.raw

SEQ ID NO: 456846 - DNA, 468 bp, Homo sapiens
  misc_feature: HEFZJCU01C5G8M.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctggcgccctgctccaggagcacctccgagagcacagcgccctgggctgcctggtcaggactacttccctacagtgct

SEQ ID NO: 456847 - DNA, 513 bp, Homo sapiens
  misc_feature: HEFZJCU01BVEXA.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacggaaggaggggggaaccgagcgggagttccgaagtactcctttgacgtcgt

SEQ ID NO: 456848 - DNA, 510 bp, Homo sapiens
  misc_feature: HEFZJCU01BU7KH.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaaggaggggggatacgagtggcagctccaagtacttacg

SEQ ID NO: 456849 - DNA, 491 bp, Homo sapiens
  misc_feature: HEFZJCU01CBVDS.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggcctcgggctgcctggtcaaggactacttccgtatctctcg

SEQ ID NO: 456850 - DNA, 313 bp, Homo sapiens; identical to SEQ ID NO: 445488
  misc_feature: HEFZJCU01DUX1Q.49.8.A08.1.454.heavy.3.raw

SEQ ID NO: 456851 - DNA, 378 bp, Homo sapiens
  misc_feature: HEFZJCU01EY5MU.2.86.H09.1.454.heavy.3.raw
acgctcgacacacgaccggtgctcgatttagtgctatagacttgggtttgggatggatcaacgctaagagtggtggcacaaactatgcacagaaatttcagggcagggtcaccatgaccagggacacgtccacagacacagcctacatggagctgaggagactgagatctgacgacacggccgtgtattattgtttcactcgaccagtggttacacaaggtcccgactttgactcctggggccagggaaccctggtcaccgtctcctcagcctccaccaagggcccatcggtcttccccctggcgccctgctccaggagcacctccgagagcacagcggccctgggctgcctggtcaaggactacttcctgtcggcgt

SEQ ID NO: 456852 - DNA, 528 bp, Homo sapiens
  misc_feature: HEFZJCU01E0JAE.9.30.C08.1.454.heavy.3.raw
tgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggactcccgtggtcaccgtctcctcagcctcc

SEQ ID NO: 456853 - DNA, 515 bp, Homo sapiens
  misc_feature: HEFZJCU01B2RMW.48.53.E09.1.454.heavy.3.raw
agtatacatacacgaccggtgctcgatttagagagagtgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgtacaactggggccgaggggaaccctgggtcaccgtctcctcagcctccaccaagggcccatcggtcttcccctggcgccctgctccaggagcacctccgagagcacagcggccctgggctgcctggtcaaggactactt

SEQ ID NO: 456854 - DNA, 508 bp, Homo sapiens
  misc_feature: HEFZJCU01DGCDP.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggccagccggtcctttggacttcgtc

SEQ ID NO: 456855 - DNA, 502 bp, Homo sapiens
  misc_feature: HEFZJCU01BBNDD.53.14.B03.1.454.heavy.3.raw
cgcgtatacacacgaccggtgctcgatttagtgtgagtagttccgcgggcctggcgcacccaatggatagcatgggtactgagggtgtatccagaagcctggcaggaaaccttcactgaggccccaggcttcttcgcctcagccccagactgcacaagctggacctgggagtgggcacctgtggctgctgccaccaaaagaggatcctccaggtccagtccatggtgaggcgttgtgctctgggggcttctgaggagggatgtggttgttgggtcagcgctggcaatggtgacagacactattcacagaagttccagggcagagtcaccatcaccagggacacatccgcgagcacagcctacatggaactgagcagcctgagatctgaagacacgggtgtatattactgtgcgagagggaagtgggatattgtagatgcgccaggtcgcccggccggccccctactttgactactgggggccggggaaccctgggtcaccgt

SEQ ID NO: 456856 - DNA, 514 bp, Homo sapiens
  misc_feature: HEFZJCU01ECTPA.12.33.C11.1.454.heavy.3.raw
atacgacgtacacgaccggtgctcgatttagagtgagctcgttgggtttgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcggggggaggtgtagtacggccggggggtccctgagactctcatgtgcagggtctggattcaacttttacgattatggcatgacctgggtccgccaagctccagggaagggctggagtgggtctctggtctgaattggaatggtgatagtatagattatgcaggctctgtggaggggccgattcaccatcctccagagacaacgccaagaactccctgtttctgcaaatggacaatttgagagaggaagacacggccttatatttctgtgcgagacgccctcggcagaagtctggactactactattatgtatgg

SEQ ID NO: 456857 - DNA, 503 bp, Homo sapiens; identical to SEQ ID NO: 444557
  misc_feature: HEFZJCU01B4I6T.9.33.C11.1.454.heavy.3.raw

SEQ ID NO: 456858 - DNA, 483 bp, Homo sapiens; identical to SEQ ID NO: 444924
  misc_feature: HEFZJCU01E1OAS.10.35.D02.1.454.heavy.3.raw

SEQ ID NO: 456859 - DNA, 400 bp, Homo sapiens; identical to SEQ ID NO: 444452
  misc_feature: HEFZJCU01CPJD2.47.24.C02.1.454.heavy.3.raw

SEQ ID NO: 456860 - DNA, 483 bp, Homo sapiens
  misc_feature: HEFZJCU01CFVGJ.19.13.B02.1.454.heavy.3.raw
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgaggctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaatgaacagcctgagagctgaggacacggctgtgtattactgtgcgaggcgt

SEQ ID NO: 456861 - DNA, 507 bp, Homo sapiens
  misc_feature: HEFZJCU01DI3DR.16.21.B10.1.454.heavy.3.raw
  modified_base (443)..(443): a, c, t, g, unknown or other
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgtttctaggtcggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaagggctggaatgggtctcaggtattactggtggtggttataccacatactacgcagactccgtgaagggccggttcaccatctccagagacaattccaagaacacactgtatctgcaaatgaacagcctgagagccgacgacncggccatatattactgtgcgaaagcaccggcagttagcacccatctactttgactactgggccg

SEQ ID NO: 456862 - DNA, 478 bp, Homo sapiens; identical to SEQ ID NO: 448105
  misc_feature: HEFZJCU01DJH86.26.78.H01.1.454.heavy.3.raw

SEQ ID NO: 456863 - DNA, 523 bp, Homo sapiens
  misc_feature: HEFZJCU01BDAQB.22.11.A11.1.454.heavy.3.raw
acatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccgcgggggtcacccaaattgactactggggccagggaaccctggtcaccgtctcctcagcctccaccaagggcccatcggtcttcccctggcgccctgctcca

SEQ ID NO: 456864 - DNA, 538 bp, Homo sapiens
  misc_feature: HEFZJCU01DMECO.52.73.G07.1.454.heavy.3.raw
cgcagtacgacacgaccggtgctcgatttagctctacgctcagggggctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatgaaaactacgcccctggcgctatggacgtcgtggggccgaagggaccacggtcaccgtctcctcacgcctccaccaagggcccatcggtcttcccct

SEQ ID NO: 456865 - DNA, 529 bp, Homo sapiens
  misc_feature: HEFZJCU01DTHI8.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtggggccgggggaacccgtcggtcaccggtctcttcacgcctccacccaagggcccatcggtcttccccctggccaccctcctccaacgagcacctctcgggggcacagcc

SEQ ID NO: 456866 - DNA, 501 bp, Homo sapiens
  misc_feature: HEFZJCU01AJV3Z.48.34.D01.1.454.heavy.3.raw
agtatacatacacgaccggtgctcgatttagatcgtctgtgttgggtggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtatact

SEQ ID NO: 456867 - DNA, 502 bp, Homo sapiens; identical to SEQ ID NO: 451203
  misc_feature: HEFZJCU01CI3TO.10.38.D05.1.454.heavy.3.raw

SEQ ID NO: 456868 - DNA, 520 bp, Homo sapiens
  misc_feature: HEFZJCU01DA718.49.25.C03.1.454.heavy.3.raw
agtcgagagacacgaccggtgctcgatttagtagtgtagatttgggtttggggagctctgagagaggagcccagccctgggattttcaggtgttttcatttggtgatcaggactgaacagagagaactcaccatggagtttgggctgagctggctttttcttgtggctactttaaaaggtgtccagtgtgacgtccaactggtggagtctgggggaggcttggtgcagcctggggggtccctgagactctcctgtgtagcctctgagttcacctttagagtctatgccatgagttgggtccgccaggctccagggaaggggctggagtgggtctcaggtatcagtggtaatgatggtaacacaaactatgcagactccgtgaagggccggttcaccatctccagagacaattccaagaatatgctatttctgcaaatgaacagcctgagaatcgaggacacggccgtatattactgtgtgaaagaagatggaccgctggacgaggagccctacggcgggt

SEQ ID NO: 456869 - DNA, 504 bp, Homo sapiens
  misc_feature: HEFZJCU01B20I9.53.8.A08.1.454.heavy.3.raw
cgcgtatacacacgaccggtgctcgatttagcatactctacaggggctgggagaggagcccagcactagaagtcggcggtgtttccattcggtgatcagcactgaacacagaggactcaccatggagtttgggctgagctgggttttcctcgttgctcttttaagaggtgtccattgtcaggtgcagttggtggagtcgggggatctgtggtccggcctgggaggtccctgagactctcctgtacagcctccggattcagcttcgagaactatggcttgcactgggtccgccaggctccaggcaaggggccggagtgggtggcagttatttcatatgattcaagtattggatattacgcagactctgttaagggccgattcaccatctccagagacaattccaagaacaccctgtatctgcaattgagcagactcacagctgaggacacggctgtgtattactgtgtgaagacgtttatgagagtagtggttttccgagtacgc

SEQ ID NO: 456870 - DNA, 525 bp, Homo sapiens
  misc_feature: HEFZJCU01ET542.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacggtatggta

SEQ ID NO: 456871 - DNA, 378 bp, Homo sapiens; identical to SEQ ID NO: 451407
  misc_feature: HEFZJCU01CSMAY.47.46.E02.1.454.heavy.3.raw

SEQ ID NO: 456872 - DNA, 496 bp, Homo sapiens; identical to SEQ ID NO: 445798
  misc_feature: HEFZJCU01B8SZD.12.55.E11.1.454.heavy.3.raw

SEQ ID NO: 456873 - DNA, 493 bp, Homo sapiens
  misc_feature: HEFZJCU01C5QT4.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtatattactgtgcgaaagatttggggaatggaccactc

SEQ ID NO: 456874 - DNA, 503 bp, Homo sapiens; identical to SEQ ID NO: 444557
  misc_feature: HEFZJCU01BA9SD.9.33.C11.1.454.heavy.3.raw

SEQ ID NO: 456875 - DNA, 517 bp, Homo sapiens
  misc_feature: HEFZJCU01CGZKH.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctgggccaaggtacagcggtcaccgtcgcctcagcctccaccaagggcccatcggtctcccctggcaccctcctccaagagcacctctgggggcacac

SEQ ID NO: 456876 - DNA, 398 bp, Homo sapiens
  misc_feature: HEFZJCU01CNUL5.18.1.A01.1.454.heavy.3.raw
tacgagtatgcacgaccggtgctcgatttagacgtctcatcaaggaagggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaatttttgactggttattcctactactttgactactggggccagggagccctggtcaccgtctcctcagcctccaccaagggcccatcggtcttccccctggcgccctgctccaggagcacctccgagagcacagcggccctgggctgcctggtcaaggactacttcccatactcgta

SEQ ID NO: 456877 - DNA, 519 bp, Homo sapiens; identical to SEQ ID NO: 452709
  misc_feature: HEFZJCU01D8CWM.3.82.H05.1.454.heavy.3.raw

SEQ ID NO: 456878 - DNA, 515 bp, Homo sapiens
  misc_feature: HEFZJCU01CORTQ.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagcgtgggttttccttgttagctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattctgtgcgagagatggggcccacgacgttactacgtctatggacgtctggggaccg

SEQ ID NO: 456879 - DNA, 532 bp, Homo sapiens
  misc_feature: HEFZJCU01A1R20.52.75.G09.1.454.heavy.3.raw
cgcagtacgacacgaccggtgctcgatttagtatagacatcaggggagagaggagcccagccctgggatttcaggtgtttcatttggtgatcaggactgaacagagagaactcaccatggagtttgggctgagctggctttttcttgtggctattttaaaaggtgtccatggtgaggtgcggctgttggaatccgggggggcttgatacagcctggggggtccctgagactctcctgtgctgcctctggattcagtttcagtgacttagccatgagctgggtccgccaggctccagggaaggggctggaatgggtctcagtcgttactgctggacttactaccacatactacgcagactccgtgaagggccggttcgccatctccagagacaattccaagaataccctatatctgcaaatgagcagcctgagagccgagggacacggcccgtatatttactgtgcgatggggaagtagtggttactacgtactacttttgacaactggggcccaggggaaccctgggtaccg

SEQ ID NO: 456880 - DNA, 498 bp, Homo sapiens
  misc_feature: HEFZJCU01CT9FG.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaacgatgctttgatatgtggggaccg

SEQ ID NO: 456881 - DNA, 510 bp, Homo sapiens
  misc_feature: HEFZJCU01CP9TN.14.61.F06.1.454.heavy.3.raw
cgtctagtaccacgaccggtgctcgatttagctacgctctaagggaaaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagatgcctggggcctcagttgaggtctcctgcaggacttctggttacacctttaccaactatggtatcacctgggtgcggcaggtcccaggacaagggcttgagtggctgggatggatcagcggtttcgatgagaaaccagttctgcacaaaagttccagggcagactcaccctgactacagacgcatcaacgggctcagccttcatgaccctgaggaacctgagacctgacgacgcggccatctattactgtgcgagagatgggtggcagctcgtctcaggaattgacttctggggcccggaaccctggatc

SEQ ID NO: 456882 - DNA, 501 bp, Homo sapiens
  misc_feature: HEFZJCU01EPUEW.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaatgaacagcctgagaattgaggactcgggtatatactactgtgcccgtcgacccctgactgataaaccggactggttcgacccctggggccacgggaaccctggtcaccgtctcctc

SEQ ID NO: 456883 - DNA, 517 bp, Homo sapiens
  misc_feature: HEFZJCU01CXN58.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttcccctggcaccctcctccaagagcacctctgggggcacagcggccctgggctgcctggtcaaggactacttcctatacg

SEQ ID NO: 456884 - DNA, 497 bp, Homo sapiens
  misc_feature: HEFZJCU01CL1VF.12.14.B03.1.454.heavy.3.raw
atacgacgtacacgaccggtgctcgatttagtgtgagtagttccgcgggggggggaggcttggttcggcctggcgggtccctgagactctcctgcgcagcctctggattcctttttgaggattttgccatgcactgggtccggcaagctccggggagggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaaggggctctggttcagggatggggctttgactcctgggcccagggaaccctggtcgcggtctcctcagcctccaccaagggcccatcggtcttcccctggcaccctcctccaagagcacctctgggggcacagcggccctgggctgcctggtcaaggactacttcctacgtcgtat

SEQ ID NO: 456885 - DNA, 510 bp, Homo sapiens; identical to SEQ ID NO: 445542
  misc_feature: HEFZJCU01EJY23.16.21.B10.1.454.heavy.3.raw

SEQ ID NO: 456886 - DNA, 464 bp, Homo sapiens; identical to SEQ ID NO: 445553
  misc_feature: HEFZJCU01DKOWZ.19.10.A10.1.454.heavy.3.raw

SEQ ID NO: 456887 - DNA, 523 bp, Homo sapiens
  misc_feature: HEFZJCU01AG8OF.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgaccctcggggccagggaacccaggtcaccgtctcctcagcctccaccaagggcccatccgtcttcccctggcgccctgctccaggagcacctccgagagcacagcggccctgggctcgcctggtcaaggactacttcctaccg

SEQ ID NO: 456888 - DNA, 509 bp, Homo sapiens
  misc_feature: HEFZJCU01AZOER.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgacctttctggtatttcgatctctgggccgtggcaccctggtcactgtctcctcggcttccaccaagggcccatcggtcttcccctggcgcctgctccaggagcacctctggggcacagcggccg

SEQ ID NO: 456889 - DNA, 507 bp, Homo sapiens; identical to SEQ ID NO: 446637
  misc_feature: HEFZJCU01B34SO.16.34.D01.1.454.heavy.3.raw

SEQ ID NO: 456890 - DNA, 498 bp, Homo sapiens; identical to SEQ ID NO: 456747
  misc_feature: HEFZJCU01B2606.53.1.A01.1.454.heavy.3.raw

SEQ ID NO: 456891 - DNA, 511 bp, Homo sapiens
  misc_feature: HEFZJCU01BRPOY.53.39.D06.1.454.heavy.3.raw
cgcgtatacacacgaccggtgctcgatttagtgacatctcgcagttctttggggggatctcatgtgcaagaaaatgaagcacctgtggttcttcctcctgctggtggcggctcccagatgggtcctgtcccagctgcagctgcaggagtcgggcccaggactggtgaagccctcggagaccctgtccctcacctgcactatctctggtgcctccatcagcacaagtaatcactactgggctggctccgccagcccccagggaaggggctggagtggattgggagtatgtattatggtggggccacctactacaacccgtccctcaagagtcaagtcaccatatccgtagacacgtccagcaaccagttctccctgaggctgtcctctgtgaccgccgcagacacggctgtctattactgtgcgagacatgtggggccatgggagtggtcgtacaactggttcgacccctggggccagggaaccctggtcaccgtctcctcagcctccaccg

SEQ ID NO: 456892 - DNA, 511 bp, Homo sapiens
  misc_feature: HEFZJCU01B8JVD.49.6.A06.1.454.heavy.3.raw
  modified_base (470)..(470): a, c, t, g, unknown or other
agtcgagagacacgaccggtgctcgatttagatctactgacaggggagctctgagagaggagcccagccctgggattttcaggtgttttcatttggtgatcaggactgagcagagagaactcaccatggagtttgggctgagctggcttttcttgtggctattttaaaaggtgtccagtgtgaggtgcagctggtggactctgggggaggcttggtacagcctggggggtccctgagactctcctgtgcagcctctggattcacctttagcagttttgccatgggctgggtccgccaggctccagggaaggggctggagtgggtctcaactattagcggtattggtactaccacatactacgcagactccgtgaagggccgcttcaccatctccagagacaattccaagaacatggtgtttctgcaaatgagcagcctgagagccgaggacacggccgtatattactgtncgaaagttcgcgtgctaggtacatttgactactggggaccg

SEQ ID NO: 456893 - DNA, 505 bp, Homo sapiens; identical to SEQ ID NO: 444927
  misc_feature: HEFZJCU01D0AFA.17.31.C09.1.454.heavy.3.raw

SEQ ID NO: 456894 - DNA, 523 bp, Homo sapiens
  misc_feature: HEFZJCU01EZIJT.47.46.E02.1.454.heavy.3.raw
agctcacgtacacgaccggtgctcgatttagactcatctacagggaaagggggagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctgggggagacttagtacaccctggggggtccctgagactctcctgtgcagcctctggactcacctttagcaactctgtcatgggctgggtccgccaggctccggggaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggcca

SEQ ID NO: 456895 - DNA, 541 bp, Homo sapiens
  misc_feature: HEFZJCU01EWEXS.18.78.H01.1.454.heavy.3.raw
tacgagtatgcacgaccggtgctcgatttagtgtgagtagtttgggtttggggctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctgaaaaccgaggacacggccgtgtattactgtactagacaggtggattactatttgggggagttatcgcgaaacgggggggtacgtacgtacg

SEQ ID NO: 456896 - DNA, 399 bp, Homo sapiens
  misc_feature: HEFZJCU01ALPUB.17.79.H02.1.454.heavy.3.raw
cgtagactagcacgaccggtgctcgatttagtgtcacacgaagggaaaggggctggagtgggtctcaactattagtggtcgcggtactactacatattacgcagactccgtgaagggccggttcaccatctccagagacaattccaacaacacactgtttctgcaaatgaacagcctgagagccgaggacacggccgtctattactgtgcgaaagaggggaggcacattgtggtggtggctagtgttattgactactggggtcagggatccctggtcaccgtctcctcagcttccaccaagggcccatccgtcttccccctggcgccctgctccaggagcacctccgagagcacagccgccctgggctgcctggtcaaggactacttccctagtctacg

SEQ ID NO: 456897 - DNA, 501 bp, Homo sapiens
  misc_feature: HEFZJCU01EPEJL.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaaacgatagctttgatatgtgggccaagggacac

SEQ ID NO: 456898 - DNA, 490 bp, Homo sapiens; identical to SEQ ID NO: 451781
  misc_feature: HEFZJCU01CMBX4.11.13.B02.1.454.heavy.3.raw

SEQ ID NO: 456899 - DNA, 505 bp, Homo sapiens; identical to SEQ ID NO: 445664
  misc_feature: HEFZJCU01DE0QJ.12.33.C11.1.454.heavy.3.raw

SEQ ID NO: 456900 - DNA, 497 bp, Homo sapiens
  misc_feature: HEFZJCU01CJ7PB.49.85.H08.1.454.heavy.3.raw
agtcgagagacacgaccggtgctcgatttagtatcactcagtcgcggggagtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcagcttctctgggttctcactctccagtcctggagtgggtgtgggctggatccgtcagcccccaggaaaggccctggagtggcttgcactcatttattggaatgacgataagacctacagcccatctctgaagagcaggctcaccatcaccaaggacacctccaacaaccaggtggtccttacaatgaccaacatggaccctgtggacacagccacatattactgtgcacacgtccccccgccgtattattatgatgctagtggttattccaacgctgaatacttccagcactggggccagggcta

SEQ ID NO: 456901 - DNA, 485 bp, Homo sapiens
  misc_feature: HEFZJCU01AWOUI.51.67.G01.1.454.heavy.3.raw
cgatcgtatacacgaccggtgctcgatttagagtatacatattgggtttgggggggagaggagcccagcactagaagtcggcggtgcttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgaacttaatcac

SEQ ID NO: 456902 - DNA, 493 bp, Homo sapiens
  misc_feature: HEFZJCU01CH6LV.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagcgtgggttttcctcgttgctcttttaagaggtgtccagtgtcaggtgcagctggtggagtctgggggaggcgtggtccagcctgggagtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatgggaggtcgatattgt

SEQ ID NO: 456903 - DNA, 512 bp, Homo sapiens
  misc_feature: HEFZJCU01EXJL6.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtcccttactttgactactggggccagggactctggtcaccgtctccgcagcctccaccaaggcccc

SEQ ID NO: 456904 - DNA, 524 bp, Homo sapiens
  misc_feature: HEFZJCU01CKHRF.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctcaagtactactttgacttctggggccagggaaccctggtcaccgtctcctcagcctccaccaaggcccatcggtcttcccctggcgccctcgctccaggagcacctccgaga

SEQ ID NO: 456905 - DNA, 467 bp, Homo sapiens
  misc_feature: HEFZJCU01EMLMG.48.59.F04.1.454.heavy.3.raw
agtatacatacacgaccggtgctcgatttagtacacacacttagggattgggtagggattggggcagggtgtacacctgtggttctcggggctgccctttggctttggagatggttttctcgatgggggctggagtggattgggagtatttaccacagtgggagcacctactacaacccgtccctcgaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttcctatgtatact

SEQ ID NO: 456906 - DNA, 505 bp, Homo sapiens
  misc_feature: HEFZJCU01BG0EP.13.71.G05.1.454.heavy.3.raw
tcacgtactacacgaccggtgctcgatttagtgtcgtcgcaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttggggccggggaaccctggtc

SEQ ID NO: 456907 - DNA, 520 bp, Homo sapiens
  misc_feature: HEFZJCU01EYHY2.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtcgtggggccaagggaccacggtcatcgtctcctcagcctccaccaagggcccatcggtctttccccctggcctacccc

SEQ ID NO: 456908 - DNA, 313 bp, Homo sapiens; identical to SEQ ID NO: 445488
  misc_feature: HEFZJCU01BOBW6.49.8.A08.1.454.heavy.3.raw

SEQ ID NO: 456909 - DNA, 508 bp, Homo sapiens
  misc_feature: HEFZJCU01BK0V3.3.71.G05.1.454.heavy.3.raw
agacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagcgtggatttcctttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgtgtaaagtcccggggaaatatgtacgattttt

SEQ ID NO: 456910 - DNA, 493 bp, Homo sapiens; identical to SEQ ID NO: 455531
  misc_feature: HEFZJCU01AJ1L4.47.85.H08.1.454.heavy.3.raw

SEQ ID NO: 456911 - DNA, 496 bp, Homo sapiens
  misc_feature: HEFZJCU01EKP8W.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcttttgtatgcctttgatatggtgggccgaagggac

SEQ ID NO: 456912 - DNA, 517 bp, Homo sapiens
  misc_feature: HEFZJCU01CVMXZ.26.57.F02.1.454.heavy.3.raw
agactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggttcaccatctccagagatgattcagagaacacggcgtatctgcaaatgaacagcctagaaaccgaggacacggccgtgtattactgtgccagacatccgtcgtattacgtatttttctagtggt

SEQ ID NO: 456913 - DNA, 508 bp, Homo sapiens; identical to SEQ ID NO: 448191
  misc_feature: HEFZJCU01DMOHW.4.67.G01.1.454.heavy.3.raw

SEQ ID NO: 456914 - DNA, 533 bp, Homo sapiens
  misc_feature: HEFZJCU01CXQDZ.52.45.E01.1.454.heavy.3.raw
cgcagtacgacacgaccggtgctcgatttagtgagtcagtaagggaaagggggctctgggagaggagcccagcactgggattccggggtgtttccattcagtgatctgcactgaacacagaggactcgccatggagtttgggctgagctgggttttccttgttgctattttaaaaggtgtccattgtgaggtgcagctggtggagtctgggggaggcttggtccagccgggggggtccctgagactctcctgtgcagcctctgaattcagcgtcagtagcgactacatgagctgggtccgccaggctccagggaaggggctgggagtgggtcacagttattccaaccggtgggagcgcacactacgcagattccgtgaagggcaggttcaccatctccagagacaatttgaggaacacggtgcatcttcacatgaacagcctgagagccgaggacacggctgtttattactgtgcgagggtaattggaactacggcgggggacttcgacccgtcggggccacgggaacccgtc

SEQ ID NO: 456915 - DNA, 506 bp, Homo sapiens
  misc_feature: HEFZJCU01DN6CN.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaccgaggacacggccgtttattattgtacttctgaggtgacgggaaccgctggctattggggccagggaaccctggtcgccgtctcctcagcctccaccaagggcccatcggtcttccccctggcgccctgctccaggagcacctccgagagcacagcggccctgggctgcctggtcaaggactacttcctatgtatact

SEQ ID NO: 456916 - DNA, 508 bp, Homo sapiens
  misc_feature: HEFZJCU01EHGVJ.48.59.F04.1.454.heavy.3.raw
agtatacatacacgaccggtgctcgatttagtacacacacttagggattggggatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaaccg

SEQ ID NO: 456917 - DNA, 507 bp, Homo sapiens
  misc_feature: HEFZJCU01DZKA2.49.72.G06.1.454.heavy.3.raw
agtcgagagacacgaccggtgctcgatttagctacgactgcaagggaaaggggactccaaggcctttccacttggtgatcagcactgagcacagaggactcaccatggagttggggctgagctgggttttccttgttgctattttagaaggtgtccagtgtgaggtgcagctggtggactcggggggaggcttggtccagcctgggggttccctgagactctcctgtgtagtctctggattcagctttaggagttattacatgagttgggtccgccaggctccaggggaaggggctggagtgggtggccaacataaccaagatggaactggtggaagactacatagactctgtgaagggccgattcaccatctccagagacaacgccaagaattcactgttctgcacatgagcagtctgagagtcgaggacacggccttactattattgtgtgagtcagagtggcccaacccattggagccagggaaccctagtcagcgtctcctca

SEQ ID NO: 456918 - DNA, 499 bp, Homo sapiens
  misc_feature: HEFZJCU01D2UKG.48.34.D01.1.454.heavy.3.raw
agtatacatacacgaccggtgctcgatttagatcgtctgtgttgggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaaggcccatcggtcttcccctcggcgccctcgctccaggagcacctccgacgagcacagcggccctgggctgcctggtcaggactacttcctatgtatact

SEQ ID NO: 456919 - DNA, 526 bp, Homo sapiens
  misc_feature: HEFZJCU01C3GWX.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccacccaagggcccatccgtcttccccctggccgccctgctccaggagcacctccgacgagcacagcggccctgggctgcctggtcaaggactacttcctaccg

SEQ ID NO: 456920 - DNA, 520 bp, Homo sapiens; identical to SEQ ID NO: 446666
  misc_feature: HEFZJCU01DMGF2.7.78.H01.1.454.heavy.3.raw

SEQ ID NO: 456921 - DNA, 379 bp, Homo sapiens; identical to SEQ ID NO: 444450
  misc_feature: HEFZJCU01B26K4.47.77.G11.1.454.heavy.3.raw

SEQ ID NO: 456922 - DNA, 519 bp, Homo sapiens; identical to SEQ ID NO: 444867
  misc_feature: HEFZJCU01B47HQ.9.34.D01.1.454.heavy.3.raw

SEQ ID NO: 456923 - DNA, 500 bp, Homo sapiens
  misc_feature: HEFZJCU01EA2IT.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctgggccaaggggac

SEQ ID NO: 456924 - DNA, 519 bp, Homo sapiens
  misc_feature: HEFZJCU01DZ7AC.10.9.A09.1.454.heavy.3.raw
catagtagtgcacgaccggtgctcgatttagcgagacgcgcagggggggagaggagcccagcactagaagtcggcggtgtttccattcggtgatcagcactgaacacagaggactcaccatggagtctgggctgaactgggttttcctcgttgctcttttaagaggtgtccagtgtcaagtgcaactggtggagtctgggggaggcgtagtccagcctggggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccaggcgggagtccaagtactcttgacgtcgtgggccg

SEQ ID NO: 456925 - DNA, 509 bp, Homo sapiens
  misc_feature: HEFZJCU01DCQ3W.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccggggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggactttcgtggggccaac

SEQ ID NO: 456926 - DNA, 505 bp, Homo sapiens
  misc_feature: HEFZJCU01AQ5CC.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccagggacactggtcaccgtctcttcagcctccaccaagggcccatcggtcttcccctggcgcctgctccaggacg

SEQ ID NO: 456927 - DNA, 491 bp, Homo sapiens
  misc_feature: HEFZJCU01DL4YL.53.30.C08.1.454.heavy.3.raw
cgcgtatacacacgaccggtgctcgatttagtctgacgtcaaagggaaaggggtctgggagacgagcccagcactggaagtcgccggtgtttccattcggtgatcatcactgaacacagaggactcaccatggagtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctatgcactgggtccgccaggctccaggcaaggggctggagtgggtggcacttatctcatctgatggaagagatgtctattacgcagactccgtgaagggccgattcaccatctccagagacaattccaagaacacactgtatctgcaaatggacagtctgagaactgaagacacggctgtgtattactgtgcgagtgagatgtctta

SEQ ID NO: 456928 - DNA, 497 bp, Homo sapiens
  misc_feature: HEFZJCU01D4NL0.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgacaactgacgagcctgagagctgacgacacggccgtctattactgtgcgagaatgttttctgtcatcgtacaatttgataggctcatgactggactt

SEQ ID NO: 456929 - DNA, 390 bp, Homo sapiens; identical to SEQ ID NO: 444541
  misc_feature: HEFZJCU01AXH3C.16.24.C02.1.454.heavy.3.raw

SEQ ID NO: 456930 - DNA, 396 bp, Homo sapiens; identical to SEQ ID NO: 444469
  misc_feature: HEFZJCU01D2HZO.47.46.E02.1.454.heavy.3.raw

SEQ ID NO: 456931 - DNA, 497 bp, Homo sapiens
  misc_feature: HEFZJCU01EBL81.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccatatatttctgtgcgcgaggaatttcgacttctggaatattacttgggttgaaact

SEQ ID NO: 456932 - DNA, 503 bp, Homo sapiens; identical to SEQ ID NO: 451946
  misc_feature: HEFZJCU01B7X1V.9.33.C11.1.454.heavy.3.raw

SEQ ID NO: 456933 - DNA, 394 bp, Homo sapiens
  misc_feature: HEFZJCU01A8SGV.10.42.D09.1.454.heavy.3.raw
catagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaagggctggttacatgtttgactcctggggccagggaatcctggtcaccgtctcctcagcctccaccaagggcccatcggtcttccccctggcgccctgctccaggagcacctccgagagcacagcggccctgggctgcctggtcaaggactacttccactactatg

SEQ ID NO: 456934 - DNA, 535 bp, Homo sapiens
  misc_feature: HEFZJCU01DCQK3.11.10.A10.1.454.heavy.3.raw
cgagagataccacgaccggtgctcgatttagcgtcgatctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatgggacattctgccattgtgattactactactactactacatggacgtctgggcaaagggaccacggtcaccgtctcctcagcctccaccaagggcccatcggtcttccccctggcaccctcctccaagagcacctctgggggcacagcggccctgggctgcctggtcaaggactacttccgtatctctcgc

SEQ ID NO: 456935 - DNA, 486 bp, Homo sapiens; identical to SEQ ID NO: 454595
  misc_feature: HEFZJCU01AXLPT.16.12.B01.1.454.heavy.3.raw

SEQ ID NO: 456936 - DNA, 507 bp, Homo sapiens
  misc_feature: HEFZJCU01BG1T8.53.53.E09.1.454.heavy.3.raw
cgcgtatacacacgaccggtgctcgatttagagagagtgtgttgggtttggggctgggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccaagaacacactgtttcttcaaatggacttcctgagaactgaggacacggccgtgtattactgcgcgagagtgcatgatagtggtttccatgatgcttttg

SEQ ID NO: 456937 - DNA, 503 bp, Homo sapiens
  misc_feature: HEFZJCU01DPNRD.52.23.C01.1.454.heavy.3.raw
cgcagtacgacacgaccggtgctcgatttagtacacgtgattagggattggggctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgcaggctccaggcaaggggctggagtgggtggcatttatatcaaatgatggaaataagaaatactatatagactcgtgaggggcattcaccatctccagagacaattccaagaacacgctgtatctgcacatgaacagcctgagagccgaagacacgggtgtttatactgtgcgaacttaattacggaggacaacggtaatgcccg

SEQ ID NO: 456938 - DNA, 502 bp, Homo sapiens
  misc_feature: HEFZJCU01AWBUS.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctgggagtggggtggcaggttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttctatagaggtgacgtacgggggcgttcg

SEQ ID NO: 456939 - DNA, 515 bp, Homo sapiens; identical to SEQ ID NO: 445422
  misc_feature: HEFZJCU01D69P9.4.57.F02.1.454.heavy.3.raw

SEQ ID NO: 456940 - DNA, 521 bp, Homo sapiens
  misc_feature: HEFZJCU01B24AC.49.28.C06.1.454.heavy.3.raw
agtcgagagacacgaccggtgctcgatttagagctcacgtattgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcagtgggatttgactactggggccaggggaaccccgtcaccgtctcctctcgcct

SEQ ID NO: 456941 - DNA, 519 bp, Homo sapiens
  misc_feature: HEFZJCU01C5YUS.13.76.G10.1.454.heavy.3.raw
  modified_base (496)..(496): a, c, t, g, unknown or other
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctanggacgtctggggccaagggaccg

SEQ ID NO: 456942 - DNA, 506 bp, Homo sapiens
  misc_feature: HEFZJCU01ATO4U.3.23.C01.1.454.heavy.3.raw
agacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccaagggcccatcggtcttcccctggcg

SEQ ID NO: 456943 - DNA, 522 bp, Homo sapiens
  misc_feature: HEFZJCU01DAF7A.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccgattcaccatctccagagacaattccaagaacacgatgtatctgcaaatggacagcctaagagttgaggacacggctgtttaattactgtacgaaagagggggatacagtggcagctccaagtactacttgacttctgggccagggaaccctggtcaccgtctcctcagcctccaccaagggcccatcggtcttcccctggccgcctcgctccaggacgcacctccg

SEQ ID NO: 456944 - DNA, 491 bp, Homo sapiens
  misc_feature: HEFZJCU01D9LX9.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctcggcgccctgctccaggagcacctccgagagcacagcggccctgggctgcctgtcaaggactacttccgtatctctcg

SEQ ID NO: 456945 - DNA, 492 bp, Homo sapiens
  misc_feature: HEFZJCU01D41TX.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaaggccatcggtcttcccctgcgccctgctccaggagcacctccgagagcacagcggccctgggctgcctggtcaaggactacttccctacagtgct

SEQ ID NO: 456946 - DNA, 523 bp, Homo sapiens
  misc_feature: HEFZJCU01EC6IL.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgacccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctggggccgt

SEQ ID NO: 456947 - DNA, 491 bp, Homo sapiens; identical to SEQ ID NO: 456408
  misc_feature: HEFZJCU01DPHQ2.19.53.E09.1.454.heavy.3.raw

SEQ ID NO: 456948 - DNA, 525 bp, Homo sapiens
  misc_feature: HEFZJCU01ERA4F.12.33.C11.1.454.heavy.3.raw
atacgacgtacacgaccggtgctcgatttagagtgagctcgttgggtttggggggaagaggaagactgacggtcccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtcgtggggccaagggaccacggtcatcgtctcctcagcctccaccaagggcccatcggtcttcccctggcaccctcctccaagagcacctctgggggcacagcc

SEQ ID NO: 456949 - DNA, 378 bp, Homo sapiens; identical to SEQ ID NO: 444463
  misc_feature: HEFZJCU01BZXFE.47.77.G11.1.454.heavy.3.raw

SEQ ID NO: 456950 - DNA, 484 bp, Homo sapiens; identical to SEQ ID NO: 448254
  misc_feature: HEFZJCU01AHRAG.12.75.G09.1.454.heavy.3.raw

SEQ ID NO: 456951 - DNA, 479 bp, Homo sapiens; identical to SEQ ID NO: 447128
  misc_feature: HEFZJCU01DP9HL.4.37.D04.1.454.heavy.3.raw

SEQ ID NO: 456952 - DNA, 507 bp, Homo sapiens
  misc_feature: HEFZJCU01B05EP.11.19.B08.1.454.heavy.3.raw
cgagagataccacgaccggtgctcgatttagtgagtcagtaaggggctcagagaggtgccttagccctggattccaaggcatttccacttggtgatcagcactgaacacagaggactcaccatggagttggggctgtgctgggttttccttgttgctattttagaaggtgtccagtgtgaggtgcaggtggtggagtctgggggaagcttggtacagcctggagggtccctgagactcttctgtgcagcctctggattcgactttagtagttatgaaatgaactgggtccgccaggctccagggaaggggctggagtgggtttcatacatttctagtaattctggtaccatacactatgcagtctctgtgaagggccgattcaccatctccagagacaacgccaggaactcactttatctgcaaatgagcagcctgagagtcgaggacacgggtatttagttactgttgcgagagatagtctgtctatgcttccgggagcgtaacta

SEQ ID NO: 456953 - DNA, 530 bp, Homo sapiens
  misc_feature: HEFZJCU01DKUOM.4.59.F04.1.454.heavy.3.raw
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctccctgaggctgagctctgtgaccgccgcggacacggccgtgtatttctgtgcgagatctttcgatttttggagtggtaacccccttggctactggggccagggaaccctggtcaccgtctcttcagcctccaccaagggccca

SEQ ID NO: 456954 - DNA, 484 bp, Homo sapiens
  misc_feature: HEFZJCU01AGTG9.19.53.E09.1.454.heavy.3.raw
tactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaacctccctgtatctgcaaatgaacagtctgagagctgaggacacggccttgtattactgtgcaaggaggtatagc

SEQ ID NO: 456955 - DNA, 483 bp, Homo sapiens
  misc_feature: HEFZJCU01EBH25.19.13.B02.1.454.heavy.3.raw
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtgcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaggcggt

SEQ ID NO: 456956 - DNA, 498 bp, Homo sapiens
  misc_feature: HEFZJCU01DR4RL.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttcccctggcaccctcctccaagagcacctctgggggcacagcggccctgggctgcctggtcaaggactactccgagtagtaca

SEQ ID NO: 456957 - DNA, 501 bp, Homo sapiens; identical to SEQ ID NO: 445027
  misc_feature: HEFZJCU01DSQ4Z.26.23.C01.1.454.heavy.3.raw

SEQ ID NO: 456958 - DNA, 400 bp, Homo sapiens; identical to SEQ ID NO: 444452
  misc_feature: HEFZJCU01CHHQD.47.24.C02.1.454.heavy.3.raw

SEQ ID NO: 456959 - DNA, 515 bp, Homo sapiens
  misc_feature: HEFZJCU01C5TN1.21.4.A04.1.454.heavy.3.raw
  modified_base (497)..(497): a, c, t, g, unknown or other
tcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactgggtcccgccaggctccagggaaggggctggagtgggtcggccgtattacaaggaaagctaacagttacagtacagaatacggcgcgtctgtgaaaggaaggttcaccatctcaagagatgattcaaagaactcactgtatctgcaaatgaacagcctaggaaaacccgaggaccacgggccgtgtattattgtggtagaacaaaagnggtaggatgtggtggtag

SEQ ID NO: 456960 - DNA, 324 bp, Homo sapiens; identical to SEQ ID NO: 444475
  misc_feature: HEFZJCU01CJWKQ.18.17.B06.1.454.heavy.3.raw

SEQ ID NO: 456961 - DNA, 515 bp, Homo sapiens
  misc_feature: HEFZJCU01ES0PR.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagatggggcccacggaacgttactacgctatggacgtcgtgggaccg

SEQ ID NO: 456962 - DNA, 327 bp, Homo sapiens
  misc_feature: HEFZJCU01DTXJB.40.20.B09.1.454.heavy.3.raw
tctagcgactcacgaccggtgctcgatttagtgtagtgtgaagggccgattcaccatctccagagacaacgccgggaactccctgtatctgcaaatgaagagcctgcgagccgaggacacgggtgtttattattgtactaaaggacaagagggacttttgggagtactactacggtatggacgtctggggccaagggaccgccgtcaccgtctcctcagcttccaccaagggcccatcggtcttccccctggcgccctgctccaggagcacctctggggcacagcggccctgggctgcctggtcaaggactacttccagtcgctaga

SEQ ID NO: 456963 - DNA, 400 bp, Homo sapiens; identical to SEQ ID NO: 444452
  misc_feature: HEFZJCU01B4H1B.47.24.C02.1.454.heavy.3.raw

SEQ ID NO: 456964 - DNA, 523 bp, Homo sapiens
  misc_feature: HEFZJCU01B8ZF9.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaaacaacctgagagccgacgacacggccgtttattactgtgcgagagattcgagtggttcggggaccgtcaccctggttctacttcgatctctggggc

SEQ ID NO: 456965 - DNA, 503 bp, Homo sapiens
  misc_feature: HEFZJCU01CH9CR.22.11.A11.1.454.heavy.3.raw
acatacgcgtcacgaccggtgctcgatttagctacgactgcagggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccagggaaggggctggagtggatctcagttatttatctcggtgtaacacatactacgcagactccgtggagggccgattcaccatctccagagacaattccaagaacacggtgtatcttcaaatgaacagcctgagagccgatgacacggccgtgtattactgtgtgagatacaaattaccaagccggcgggggtccacccaat

SEQ ID NO: 456966 - DNA, 396 bp, Homo sapiens; identical to SEQ ID NO: 445898
  misc_feature: HEFZJCU01EERXO.10.42.D09.1.454.heavy.3.raw

SEQ ID NO: 456967 - DNA, 491 bp, Homo sapiens; identical to SEQ ID NO: 446104
  misc_feature: HEFZJCU01D9KHJ.3.34.D01.1.454.heavy.3.raw

SEQ ID NO: 456968 - DNA, 490 bp, Homo sapiens; identical to SEQ ID NO: 449137
  misc_feature: HEFZJCU01BAZP8.11.26.C04.1.454.heavy.3.raw

SEQ ID NO: 456969 - DNA, 505 bp, Homo sapiens; identical to SEQ ID NO: 447076
  misc_feature: HEFZJCU01DOU4L.10.38.D05.1.454.heavy.3.raw

SEQ ID NO: 456970 - DNA, 512 bp, Homo sapiens; identical to SEQ ID NO: 450914
  misc_feature: HEFZJCU01CGII6.15.67.G01.1.454.heavy.3.raw

SEQ ID NO: 456971 - DNA, 339 bp, Homo sapiens; identical to SEQ ID NO: 444436
  misc_feature: HEFZJCU01E12YL.47.38.D05.1.454.heavy.3.raw

SEQ ID NO: 456972 - DNA, 509 bp, Homo sapiens
  misc_feature: HEFZJCU01BCU99.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggcctgggctgcctgtcaaggactactt

SEQ ID NO: 456973 - DNA, 528 bp, Homo sapiens
  misc_feature: HEFZJCU01AR1SY.18.33.C11.1.454.heavy.3.raw
tacgagtatgcacgaccggtgctcgatttagagtgagctcgttgggttttccttgttgcctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaagggcccatcggtcttccccctggcaccctcctccaagagcacctctgggggcacagcggccctgggctgcctggtcaaggactacttcccatactcgta

SEQ ID NO: 456974 - DNA, 512 bp, Homo sapiens
  misc_feature: HEFZJCU01BPYPH.10.85.H08.1.454.heavy.3.raw
catagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccac

SEQ ID NO: 456975 - DNA, 347 bp, Homo sapiens
  misc_feature: HEFZJCU01A12JP.11.81.H04.1.454.heavy.3.raw
cgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgtagctcttttaagaagtgattcatggagaaatagagagactgagtcctccaccaagggcccatcggtcttccccctggcaccctcctccaagagcacctctgggggcacagcggccctgggctgcctggtcaaggactacttccgtatctctcg

SEQ ID NO: 456976 - DNA, 510 bp, Homo sapiens; identical to SEQ ID NO: 451809
  misc_feature: HEFZJCU01A4ZW2.18.39.D06.1.454.heavy.3.raw

SEQ ID NO: 456977 - DNA, 529 bp, Homo sapiens; identical to SEQ ID NO: 446480
  misc_feature: HEFZJCU01AQC0B.18.33.C11.1.454.heavy.3.raw

SEQ ID NO: 456978 - DNA, 332 bp, Homo sapiens; identical to SEQ ID NO: 446898
  misc_feature: HEFZJCU01B72IZ.12.71.G05.1.454.heavy.3.raw

SEQ ID NO: 456979 - DNA, 524 bp, Homo sapiens
  misc_feature: HEFZJCU01BS9FJ.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagagtggggcccacgaacgttactacgctatgacgtctggggccaagggaccac

SEQ ID NO: 456980 - DNA, 508 bp, Homo sapiens
  misc_feature: HEFZJCU01BRIBF.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccaggggacaagtccaccaacacagcctacatggaactaaggggactgacatctgacgacacggccatgtattattgtgcgagagaaatgttaggtactgctttgggtccctggggcccgggaacccgggtc

SEQ ID NO: 456981 - DNA, 533 bp, Homo sapiens
  misc_feature: HEFZJCU01EWXXP.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaagggctggtgtgggtctcacatattaatctcgatgggagtaatttagcctacacggactccgtcaagggccgattcaccgtctccagagacaacaccaagaacacactatatctgcagattgacagtctgagacccgaggacacggctgtgtattactgtgcaaggcagttcgtggaaacagttatgggttggggggagttggggtttttttttcgttacttacggggt

SEQ ID NO: 456982 - DNA, 509 bp, Homo sapiens
  misc_feature: HEFZJCU01DPFSW.21.23.C01.1.454.heavy.3.raw
tcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaaggccccagaactggaactacgccatggacgtctggggcaaac

SEQ ID NO: 456983 - DNA, 479 bp, Homo sapiens; identical to SEQ ID NO: 447128
  misc_feature: HEFZJCU01CCZ6P.4.37.D04.1.454.heavy.3.raw

SEQ ID NO: 456984 - DNA, 508 bp, Homo sapiens
  misc_feature: HEFZJCU01AH7N2.5.31.C09.1.454.heavy.3.raw
atcagacacgcacgaccggtgctcgatttagacgtctcatcaaggaaggaagggggctctgggagaggagccccagccctgagattcccaggtgtttccattcggtgatcagcactgaacacagagaacgcaccatggagtttggactgacctgggttctccttgttgctattttaaaaggtgtccagtgtgcagtgcagctggtgcagtcggggggagtcgtggtgcagcctggggggtccctgacactctcctgtgaagcctctggattcacgttcgatgattataccatgcactgggtccgtcaagttccggggaccggtctagagtgggtcgcttttatcagttgggatggtggcgccacagcctatgcagactctttgaagggccgattcaccatctccagagacaacaccaataactccctctttctgcaaatgacgagtctgaagactgacgacactggcttgtattactgtgtcaagagggtggcgcgataggagccttt

SEQ ID NO: 456985 - DNA, 538 bp, Homo sapiens
  misc_feature: HEFZJCU01DQ2G1.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaagtaatggctgtgtttatgggggccaggggagccctggtcctaccg

SEQ ID NO: 456986 - DNA, 526 bp, Homo sapiens
  misc_feature: HEFZJCU01CEFB9.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgccctgctccaggagcacctccgagagcacagcggccctgggcc

SEQ ID NO: 456987 - DNA, 495 bp, Homo sapiens
  misc_feature: HEFZJCU01EW3VY.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccaggggaaccctggtcaccgtctcctcagcctccaccaagggcccatcggtcttcccctggcaccctcctccaagagcacctctgggggcacagcggccctggctgcctggtcaggactacttccgagtagtaca

SEQ ID NO: 456988 - DNA, 490 bp, Homo sapiens; identical to SEQ ID NO: 449137
  misc_feature: HEFZJCU01BMVX4.11.26.C04.1.454.heavy.3.raw

SEQ ID NO: 456989 - DNA, 482 bp, Homo sapiens; identical to SEQ ID NO: 444503
  misc_feature: HEFZJCU01D7FJM.7.10.A10.1.454.heavy.3.raw

SEQ ID NO: 456990 - DNA, 506 bp, Homo sapiens
  misc_feature: HEFZJCU01EY07L.53.33.C11.1.454.heavy.3.raw
cgcgtatacacacgaccggtgctcgatttagagtgagctcgttgggtttgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgaccctgggccagggaaccctggtcaccgtctcctcagcttccaccaagggcccatcggtcttcccctgcgccctgctccaggagcacctctgggggcacagcggcccgtggctgcctggtcaaggactacttcctcgtactgcg

SEQ ID NO: 456991 - DNA, 314 bp, Homo sapiens; identical to SEQ ID NO: 444774
  misc_feature: HEFZJCU01ACL5Y.7.10.A10.1.454.heavy.3.raw

SEQ ID NO: 456992 - DNA, 396 bp, Homo sapiens; identical to SEQ ID NO: 444469
  misc_feature: HEFZJCU01BIQYQ.47.46.E02.1.454.heavy.3.raw

SEQ ID NO: 456993 - DNA, 503 bp, Homo sapiens
  misc_feature: HEFZJCU01DVPC6.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaagactgcacagaagtttcagggcagggtcaccatgaccagggacaagtccaccaacacagcctacatggaactaaggggactgacatctgacgacacggccatgtattattgtgcgagagaaatgttaggtactgctttgggtccctgggcccggaaccgggtc

SEQ ID NO: 456994 - DNA, 483 bp, Homo sapiens
  misc_feature: HEFZJCU01B8M6S.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcgtcttcccctcggcaccctcctccaagagcacctctgggggcacagcggccctgggctgcctggtcaaggactacttccgtatctctcg

SEQ ID NO: 456995 - DNA, 497 bp, Homo sapiens; identical to SEQ ID NO: 445400
  misc_feature: HEFZJCU01AC6TB.40.37.D04.1.454.heavy.3.raw

SEQ ID NO: 456996 - DNA, 500 bp, Homo sapiens
  misc_feature: HEFZJCU01B45IB.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcaggggtcaccatgaccagggacacgtccatcagtacagcctacatggagctgagcagtctgagacctgacgacacggcccgtgtattattgtgcgttagttacggacgattacgacgttttgattggt

SEQ ID NO: 456997 - DNA, 513 bp, Homo sapiens
  misc_feature: HEFZJCU01DNJV5.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccaggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccaac

SEQ ID NO: 456998 - DNA, 384 bp, Homo sapiens; identical to SEQ ID NO: 444454
  misc_feature: HEFZJCU01DWAA5.11.61.F06.1.454.heavy.3.raw

SEQ ID NO: 456999 - DNA, 422 bp, Homo sapiens
  misc_feature: HEFZJCU01CV6BZ.16.78.H01.1.454.heavy.3.raw
tgtactactccacgaccggtgctcgatttagtgtgagtagtttgggtttggggcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagctgacgacacggctgtgtattactgtgcgggagccgtaacttcgggggactacctcgacccctggggccagggaatactggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 457000 - DNA, 507 bp, Homo sapiens; identical to SEQ ID NO: 448371
  misc_feature: HEFZJCU01CFXEE.3.81.H04.1.454.heavy.3.raw

SEQ ID NO: 457001 - DNA, 512 bp, Homo sapiens
  misc_feature: HEFZJCU01BU7OB.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatccagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcgagggggccgggatattgttatagaaccacctgctatctgagctggttcgactgctggggccagggaaccctggtcaccg

SEQ ID NO: 457002 - DNA, 490 bp, Homo sapiens
  misc_feature: HEFZJCU01BIR9K.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgatctgcaaatgaccagcctgagagccgaggacacgggtgttattactgtgggagaaatcctagt

SEQ ID NO: 457003 - DNA, 513 bp, Homo sapiens
  misc_feature: HEFZJCU01AE4VB.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggccgccctgctccaggagcacctctgggggcacgagcggccctgggctgcctggtcaggactactcccatacg

SEQ ID NO: 457004 - DNA, 509 bp, Homo sapiens
  misc_feature: HEFZJCU01BZONQ.49.61.F06.1.454.heavy.3.raw
agtcgagagacacgaccggtgctcgatttagctacgctctaagggaaagggtctgtgaagccttcacagaccctgtccctcacctgcgctgtctctggtggctccatcaccagtggtggttattcctggacttggatccggcagccaccagggaaggccctggagtggattgggcacatctatcatagtgggaccacctactacaacccgtccctccagagtcgagtcaccatatcagtcgacatgtccgagaaccagttctccctgtacctccactctgtgaccgccgcggacacggccgtctattactgtgccagaggggaactctacttcggggagttaggaatcgctcctgcatttgacatctggggccagggaaacctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 457005 - DNA, 483 bp, Homo sapiens
  misc_feature: HEFZJCU01A3753.53.32.C10.1.454.heavy.3.raw
cgcgtatacacacgaccggtgctcgatttagtatagacatcaacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcagggcagggtcaccatgaccagggacacgtccatcagcacagcctacatggagctacacggcctgagatctgacgacacggccctgtattttgtgcgagagagtctataagtgctt

SEQ ID NO: 457006 - DNA, 507 bp, Homo sapiens
  misc_feature: HEFZJCU01D4EVI.10.38.D05.1.454.heavy.3.raw
catagtagtgcacgaccggtgctcgatttagtatctgatagttgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagccaggtcaccgtctccccagcctccaccaagggcccatcggcttccccctcggcgccctcgctccaggagcacctccgagagcacagcggccctgggctgcctc

SEQ ID NO: 457007 - DNA, 454 bp, Homo sapiens
  misc_feature: HEFZJCU01CC5MZ.52.53.E09.1.454.heavy.3.raw
cgcagtacgacacgaccggtgctcgatttagagagagtgtgttgggtttggggggaagaggaagactgacggtccccccaggagttcaggtgctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttccccctggcaccctcctccaagagcacctctgggggcacagcggccctgggctgcctggtcaaggactacttcctatacgatcg

SEQ ID NO: 457008 - DNA, 506 bp, Homo sapiens; identical to SEQ ID NO: 446520
  misc_feature: HEFZJCU01B8O8W.10.38.D05.1.454.heavy.3.raw

SEQ ID NO: 457009 - DNA, 514 bp, Homo sapiens
  misc_feature: HEFZJCU01AT1XH.12.55.E11.1.454.heavy.3.raw
atacgacgtacacgaccggtgctcgatttagcactcgcacgttgggtttgggctgagctgggttttcctcgttgctcttttaagaggtgtccagtgtcagatgcagctggtggagtctgggggaggcgtggtccggcctgggacgtccctgacactctcctgtgcaaccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcacctctc

SEQ ID NO: 457010 - DNA, 514 bp, Homo sapiens
  misc_feature: HEFZJCU01CFNPV.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatagaacagcctgagacgccgacgacacggccatatattactgtgcgaaagcaaccggcagttagtcacccatactactttgtactactggggccg

SEQ ID NO: 457011 - DNA, 503 bp, Homo sapiens
  misc_feature: HEFZJCU01E1SCZ.10.12.B01.1.454.heavy.3.raw
  modified_base (455)..(455): a, c, t, g, unknown or other
catagtagtgcacgaccggtgctcgatttagtagtgtagattccgcggggagctctgggagacgagcccagcactggaagtcgccggtgtttccattcggtgatcatcactgaacacagaggactcaccatggagttggggctgagcgtggtttcgtcgttaggctctttaagaggtgtccagtgtcaggtgcagttggaggaatctgggggaggcgtggtccagccagggaggtccctgagactctcctgtgcagcctctggattgaggttcaataactatgctatgcactgggtccgccaggctccaggaaggggctggaatggatgacagttatttcacacgatgcaaccaaaacatactacgcggagttcgtgaggggcgctgcatcgtctccagagacaattcgaagaacactctgtacctgcaaatgaacagtctgagagccgaggacncggccgtctacttttgtgcgactagaagtgggagctataggggatttg

SEQ ID NO: 457012 - DNA, 519 bp, Homo sapiens; identical to SEQ ID NO: 446650
  misc_feature: HEFZJCU01DD11G.13.76.G10.1.454.heavy.3.raw

SEQ ID NO: 457013 - DNA, 514 bp, Homo sapiens
  misc_feature: HEFZJCU01ASESS.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagcgtgcgttttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattacgtggtggtggttataccacatactacgcagactccgtgaagggccggttcaccatcctccagagacaattccaagaacacactgtatctgcaaatgaacagcctgagagccgacgacacggccatatattactgtgcgaaagcaccggcagttagtcacccatactactttgactactggggccac

SEQ ID NO: 457014 - DNA, 469 bp, Homo sapiens
  misc_feature: HEFZJCU01EWK6N.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggccatcggtcttcccctggcgccctgctccaggagcacctccgagagcacagcggccctgggctgcctggtcaaggactacttccctacagtgct

SEQ ID NO: 457015 - DNA, 509 bp, Homo sapiens
  misc_feature: HEFZJCU01EOLGB.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggcccgtctatttattgtgtcatagacctaggatacaacgac

SEQ ID NO: 457016 - DNA, 504 bp, Homo sapiens
  misc_feature: HEFZJCU01BCKUL.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgatacggccgtctattactgtgcgagagtcccacgatccggtgagcctacggcagcggcctttgactttctc

SEQ ID NO: 457017 - DNA, 517 bp, Homo sapiens
  misc_feature: HEFZJCU01EV5ZE.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactaaccatggagttttggctgagcgtggtttcgtgtaggctatttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttacacgctatggacgtctggggccaagggaccac

SEQ ID NO: 457018 - DNA, 483 bp, Homo sapiens; identical to SEQ ID NO: 444639
  misc_feature: HEFZJCU01EBX6F.11.23.C01.1.454.heavy.3.raw

SEQ ID NO: 457019 - DNA, 504 bp, Homo sapiens
  misc_feature: HEFZJCU01DEW74.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttcccctggcacctcctccaagagcacctctgggggcacagcggccctgggctgcctggtcaggactacttccgtactagacg

SEQ ID NO: 457020 - DNA, 524 bp, Homo sapiens
  misc_feature: HEFZJCU01DS9IW.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccagagcacctccgagagcacagcggccctgggctgcctggtcaaggactacttcca

SEQ ID NO: 457021 - DNA, 524 bp, Homo sapiens; identical to SEQ ID NO: 448642
  misc_feature: HEFZJCU01BE4PL.53.10.A10.1.454.heavy.3.raw

SEQ ID NO: 457022 - DNA, 518 bp, Homo sapiens
  misc_feature: HEFZJCU01BAKSE.12.40.D07.1.454.heavy.3.raw
  modified_base (484)..(484): a, c, t, g, unknown or other
atacgacgtacacgaccggtgctcgatttagtgatagagcgtaacaacagagggctcaccatggagtttgggctgagcgtggtttcgtcgtaggctctttaagtaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacattacaagaacaccctttatctgcaaatagacagcctgagaccagacgacaccggctgtctattattgcgcgagagagacacacgaacctactggccaatactatgggggcttgttctggggccaggggcctggtcatcgtctccccngcctcaccaaggcccatcggtcttcccctggccg

SEQ ID NO: 457023 - DNA, 535 bp, Homo sapiens
  misc_feature: HEFZJCU01BG75N.40.27.C05.1.454.heavy.3.raw
tctagcgactcacgaccggtgctcgatttagacgcgatcgaaggatttggggccatccccacctgtggttcttcctcctgctggtggcggctcccagatgggtcctgtcccagttgcagttgcaggagtcgggcccaggactggtgaagagttcggagaccctgtccctcacgtgcactgtctctggtggctccatccgcaatcgtcgattctattggggctgggtccgccggcccccagggaaggggctggagtggattgcgagcatatattatgatgagagcgccctctacaacccccccctctacaacccctccctcaagagtcgggtcaccatatctatagacacgtccaacagtcaattctccctggacttgacctctgtgaccgccgcagacacggctgtatattcctgtgcgacccacggaggggatggccccaaatctgcctactttgaccactgggaccagggaaccttggtcaccgtctcctcagcctccaccaagggcccatcggtcttcccctggccgccctg

SEQ ID NO: 457024 - DNA, 336 bp, Homo sapiens; identical to SEQ ID NO: 444429
  misc_feature: HEFZJCU01EWH7N.14.28.C06.1.454.heavy.3.raw

SEQ ID NO: 457025 - DNA, 510 bp, Homo sapiens
  misc_feature: HEFZJCU01EZRFI.12.14.B03.1.454.heavy.3.raw
atacgacgtacacgaccggtgctcgatttagtgtgagtagtttgagtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggcgggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttccccctggcaccctcctccaagagcacctctgggggcacagcggccctgggctgcctggtcaaggactacttcctacgtcgtat

SEQ ID NO: 457026 - DNA, 394 bp, Homo sapiens; identical to SEQ ID NO: 444701
  misc_feature: HEFZJCU01ENGYC.3.12.B01.1.454.heavy.3.raw

SEQ ID NO: 457027 - DNA, 506 bp, Homo sapiens; identical to SEQ ID NO: 444696
  misc_feature: HEFZJCU01D1FYW.16.34.D01.1.454.heavy.3.raw

SEQ ID NO: 457028 - DNA, 523 bp, Homo sapiens; identical to SEQ ID NO: 448340
  misc_feature: HEFZJCU01DBJKZ.12.33.C11.1.454.heavy.3.raw

SEQ ID NO: 457029 - DNA, 327 bp, Homo sapiens
  misc_feature: HEFZJCU01CT3YY.4.29.C07.1.454.heavy.3.raw
agcactgtagcacgaccggtgctcgatttagagtgctacgaagggaaagggccggttcaccatctccagagacaattccaagaacaccctgtatctgcaaatgaacagcctgagagccgaggacacggccgtatattactgtgcaaaagattttgtagcagtgtccctaagtctttttgactcctggggccagggaaccctggtcaccgtctcctcagcttccaccaagggcccatccgtcttccccctggcgccctgctccaggagcacctccgagagcacagccgccctgggctgcctggtcaaggactacttccctacagtgct

SEQ ID NO: 457030 - DNA, 516 bp, Homo sapiens
  misc_feature: HEFZJCU01BI3MP.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacaatgaccaacgtgaagcctgcggacacggccacatattattgtgcacaccgacgctataccgccagctgggaaatcgacaactggttcgaccctggggccagggaacccttgtcaccgtctcctcagcctccaccaagggccca

SEQ ID NO: 457031 - DNA, 530 bp, Homo sapiens
  misc_feature: HEFZJCU01C8O03.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctcccctagcctccaccaaggggcccatcggtcttccccctggccgcctcg

SEQ ID NO: 457032 - DNA, 501 bp, Homo sapiens; identical to SEQ ID NO: 447123
  misc_feature: HEFZJCU01ES8Q8.3.20.B09.1.454.heavy.3.raw

SEQ ID NO: 457033 - DNA, 488 bp, Homo sapiens
  misc_feature: HEFZJCU01C7P3E.12.53.E09.1.454.heavy.3.raw
atacgacgtacacgaccggtgctcgatttagagagagtgtgttgggtttggggggtccctgagactctcctgtgcagcctctcgattcagcttcagtaactatgctatgcactgggtccgccaggctccaggcagggggctggagtgggtggcagttatatcatatgatggaagacataaatactacgcagactccgtgaagggccgattcaccctctccagagacaattccaagaatacgctgtatatgcaaatgaacagcctgagacctgaggacacggctatgtattactgtgcgagaggaccattttggaatgcttattataccggaaacgcttttgatatttggggccaagggacaatggtcaccgtctcttcagcctccaccaagggcccatcggtcttccccctggcaccctcctccaagagcacctctgggggcacagcggccctggctgcctggtcaaggactacttcctacgtcgtat

SEQ ID NO: 457034 - DNA, 339 bp, Homo sapiens; identical to SEQ ID NO: 444436
  misc_feature: HEFZJCU01BPCC8.47.38.D05.1.454.heavy.3.raw

SEQ ID NO: 457035 - DNA, 396 bp, Homo sapiens; identical to SEQ ID NO: 444469
  misc_feature: HEFZJCU01DM6OT.47.46.E02.1.454.heavy.3.raw

SEQ ID NO: 457036 - DNA, 505 bp, Homo sapiens; identical to SEQ ID NO: 446814
  misc_feature: HEFZJCU01DVSTJ.48.44.D11.1.454.heavy.3.raw

SEQ ID NO: 457037 - DNA, 508 bp, Homo sapiens
  misc_feature: HEFZJCU01DISJV.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcgccctgggctgcctggtcaaggactacttcctacgtcgtat

SEQ ID NO: 457038 - DNA, 502 bp, Homo sapiens
  misc_feature: HEFZJCU01EWF8L.4.25.C03.1.454.heavy.3.raw
agcactgtagcacgaccggtgctcgatttagtagtgtagatttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggtttaccccg

SEQ ID NO: 457039 - DNA, 531 bp, Homo sapiens
  misc_feature: HEFZJCU01EIWP4.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctgggtcaccgtctccccaccctccaaccg

SEQ ID NO: 457040 - DNA, 503 bp, Homo sapiens
  misc_feature: HEFZJCU01DCP9X.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatacctactttgactact

SEQ ID NO: 457041 - DNA, 503 bp, Homo sapiens
  misc_feature: HEFZJCU01EA4W6.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccgggtgagcctacggcagcggcctttgacttct

SEQ ID NO: 457042 - DNA, 526 bp, Homo sapiens
  misc_feature: HEFZJCU01EV5LF.12.58.F03.1.454.heavy.3.raw
atacgacgtacacgaccggtgctcgatttagtctgatcgagaagggaaaggggcagagaggagccttagccctggactccaaggcctttccacttggtgatcagcactgagcacagaggactcaccatggaattggggctgagctgggttttccttgttgctattttagaaggtgtccagtgtgagggacaattggtggagtctgggggaggcttggtccagccgggggggtccctgagactctcctgtacagcctctggattcactctcggaaacttttggatggtctgggtccgccaggctccagggaagggctggagtgggtggccaatatacagtcaggtggaggtacgatacactatctcgactctgtgaagggccggttcaccatctccagagacaacgccaagaattcactgtatctgcaaatgaacagcctgagagtcgaagacacgggtatttattattgtgtgcgagatctggtatttccttcgaaatgaagtgtggttcgatgtgtttgattcgg

SEQ ID NO: 457043 - DNA, 539 bp, Homo sapiens
  misc_feature: HEFZJCU01B2J08.52.33.C11.1.454.heavy.3.raw
cgcagtacgacacgaccggtgctcgatttagagtgagctcgttgggtttgggggctctgggagaggagcccagcactgggattccgaggtgtttccattcagtgatctgcactgaacacagaggactcgccatggagtttgggctgagctgggttttccttgttgctattttaaaaggtgtccagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctgggccagggaacccggtcaccgtctcctcagcctccaccaagggcccagtccggtccttcccccgtggccacccctccctccaaagacgcaccctcgtc

SEQ ID NO: 457044 - DNA, 398 bp, Homo sapiens; identical to SEQ ID NO: 444524
  misc_feature: HEFZJCU01DGIS4.7.60.F05.1.454.heavy.3.raw

SEQ ID NO: 457045 - DNA, 501 bp, Homo sapiens
  misc_feature: HEFZJCU01DQSZJ.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaagggctggtgtgggtctcacgtatcaatcctgatggcagtgttataaattatgcggactccgtgagggccgattcagcatctccagagacaacggcaagagtatactgtatctggaaatgaacaatctgagagtcgacgatacggctgtctatcattgtgttttcgatgccttcggtccgcggacttcgtgggcac

SEQ ID NO: 457046 - DNA, 384 bp, Homo sapiens; identical to SEQ ID NO: 444454
  misc_feature: HEFZJCU01DOZQH.11.61.F06.1.454.heavy.3.raw

SEQ ID NO: 457047 - DNA, 507 bp, Homo sapiens
  misc_feature: HEFZJCU01EI2DO.12.55.E11.1.454.heavy.3.raw
atacgacgtacacgaccggtgctcgatttagcactcgcacgttgggtttgggctgagcgtgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataacagtctgagacttgaggacacggctgtctattactgtgcgagagactacggtgaccttttctggtatttcgatctctggggccgtggcaccctggtcactgtctcctcggcttccaccaaggcccatcgtcttcccctggcgcctgctcagagcactcg

SEQ ID NO: 457048 - DNA, 511 bp, Homo sapiens; identical to SEQ ID NO: 449643
  misc_feature: HEFZJCU01EQ4ZM.17.33.C11.1.454.heavy.3.raw

SEQ ID NO: 457049 - DNA, 516 bp, Homo sapiens
  misc_feature: HEFZJCU01ETAR2.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaagggcccatc

SEQ ID NO: 457050 - DNA, 513 bp, Homo sapiens
  misc_feature: HEFZJCU01CTVDV.12.55.E11.1.454.heavy.3.raw
  modified_base (487)..(487): a, c, t, g, unknown or other
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttacaaataacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctcgctccnggagcacctctggggcacagcggccg

SEQ ID NO: 457051 - DNA, 409 bp, Homo sapiens; identical to SEQ ID NO: 444519
  misc_feature: HEFZJCU01A2WTP.3.41.D08.1.454.heavy.3.raw

SEQ ID NO: 457052 - DNA, 502 bp, Homo sapiens
  misc_feature: HEFZJCU01DQ10I.40.55.E11.1.454.heavy.3.raw
tctagcgactcacgaccggtgctcgatttagcactcgcacgttgggtttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaagggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtgggccaagggacaatggtcaccgt

SEQ ID NO: 457053 - DNA, 528 bp, Homo sapiens
  misc_feature: HEFZJCU01EHBPJ.12.71.G05.1.454.heavy.3.raw
  modified_base (468)..(468): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccacccaaggcccatccgtcttccccctgccgccctcgctccaggngcacctcccgagagcacacgcggccctgggcgtgcctggtcaaggactaccctaccgtcg

SEQ ID NO: 457054 - DNA, 520 bp, Homo sapiens
  misc_feature: HEFZJCU01D4KRT.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttccccctggccaccctcctccaagagcacctctgggggcacagcggccctgggctgcctggtcaaggactacttcctagagacacg

SEQ ID NO: 457055 - DNA, 495 bp, Homo sapiens
  misc_feature: HEFZJCU01D5Z7T.11.73.G07.1.454.heavy.3.raw
cgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttcaaaagtttcgaaatgagctgggtccgccaggctcctgggaaggggccggagtggatttcatacatcagtagtagtggtaacaccttgtactatgcagactctgtgaaggcgattcacatctccagagacaacgccaagaattcactgtttctgcaaatgaacagcctgagagacgaggatacggctatttactattgtgcgcgatcgacagaaaagcggtggctagtc

SEQ ID NO: 457056 - DNA, 433 bp, Homo sapiens
  misc_feature: HEFZJCU01AMXZK.11.39.D06.1.454.heavy.3.raw
cgagagataccacgaccggtgctcgatttagtgacatctcgcagttctttgggagtgtctaatgatatggtgactagactcttgagggaagggactggagtggattgggtacatctatgacggtggaagcaccacctacagtccctccctcaagagtcgagtcaccatatcattagacacttccaagtaaccaattctccctgaggttgacctctgtgaccactgcggacacggccgtctattactgtgcgagggagtcctattacgcagctggctactacgttgacttctggggccaggggaccctggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 457057 - DNA, 515 bp, Homo sapiens
  misc_feature: HEFZJCU01EIL46.51.86.H09.1.454.heavy.3.raw
cgatcgtatacacgaccggtgctcgatttagtgctatagacttgggtttggggggaagaggaagactgacggtcctcccaggagttcaggtgcagctggtggactctgggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaataaaaattatgcagactccgtgaagggccgattcaccatctccagagacaattccaagaacactctatatttgcagatgaatagcctgagaattgaggacacggctgtgtattactgtgtgagagggtcggcatattccggttttggagtaattatctactgggaacttttgatatctggggccacgggacaatggtcaccgtctcttcagcgttccaccaagggcccatcggtcttcccctggccgccctgcctccac

SEQ ID NO: 457058 - DNA, 384 bp, Homo sapiens
  misc_feature: HEFZJCU01BYVA3.18.60.F05.1.454.heavy.3.raw
tacgagtatgcacgaccggtgctcgatttagtacgtcatcagggaaagggggctggaatatattgggattacctcttacagtgggaccacccattacaacccgtccctcaaaagtcgactcaccatttccgtggacacgtcgaaaacgagttctccctggacttgacctctgtgaccgccgcagacacggctgtttattactgtgcgagacgactacctgactccaatccatactttgactattggggccgggagccctggtcaccgtctccccaccctccaccaagggcccatcggtcttccccctggcaccctcctccaagagcacctctggggcacagcggccctgggctgcctggtcaaggactacttcccatactcgta

SEQ ID NO: 457059 - DNA, 506 bp, Homo sapiens
  misc_feature: HEFZJCU01EHYCQ.48.44.D11.1.454.heavy.3.raw
agtatacatacacgaccggtgctcgatttagcgcagtacgaagggaggcatggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 457060 - DNA, 339 bp, Homo sapiens; identical to SEQ ID NO: 450710
  misc_feature: HEFZJCU01BTD5O.53.8.A08.1.454.heavy.3.raw

SEQ ID NO: 457061 - DNA, 443 bp, Homo sapiens; identical to SEQ ID NO: 446583
  misc_feature: HEFZJCU01A0GQ2.10.11.A11.1.454.heavy.3.raw

SEQ ID NO: 457062 - DNA, 519 bp, Homo sapiens
  misc_feature: HEFZJCU01D5W13.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaaggcccatcggtcttccccctggcaccctcctccaagagcacctctgggggcacagcggccctgggctgcctggtcaaggactacttccgagtagtacac

SEQ ID NO: 457063 - DNA, 440 bp, Homo sapiens; identical to SEQ ID NO: 451644
  misc_feature: HEFZJCU01AZGR8.48.23.C01.1.454.heavy.3.raw

SEQ ID NO: 457064 - DNA, 516 bp, Homo sapiens; identical to SEQ ID NO: 457049
  misc_feature: HEFZJCU01E1K1G.17.33.C11.1.454.heavy.3.raw

SEQ ID NO: 457065 - DNA, 517 bp, Homo sapiens
  misc_feature: HEFZJCU01AXNKW.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcacccctgggccagggaaccctggtcaccgtctcctcagcctccaccaagggcccatcggtcttcccctggcaccctcctccaagagcacctctgggggcacagcggccctgggctgcctggtcaaggactacttccgagtagtacac

SEQ ID NO: 457066 - DNA, 480 bp, Homo sapiens
  misc_feature: HEFZJCU01BXXJY.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcgtcttcccctgcaccctcctccaagagcacctctggggcacagcggccctgggctgcctggtcaaggactacttccgtatctctcg

SEQ ID NO: 457067 - DNA, 502 bp, Homo sapiens; identical to SEQ ID NO: 451203
  misc_feature: HEFZJCU01CEOE8.10.38.D05.1.454.heavy.3.raw

SEQ ID NO: 457068 - DNA, 476 bp, Homo sapiens
  misc_feature: HEFZJCU01DQJLP.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactattccgagtagtaca

SEQ ID NO: 457069 - DNA, 514 bp, Homo sapiens
  misc_feature: HEFZJCU01A9JI7.52.28.C06.1.454.heavy.3.raw
  modified_base (471)..(471): a, c, t, g, unknown or other
cgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaagggcttgagtggatggggtggaacaatcccaacagtggaggcaccggtcgcacagaatatgcgcggaagtttcagggcagggtcaccatgaccagcgacaggtccactaacacagcctacatggagctaagtaagactgacatctgacgacacggccgtctattattgtntgagagaggacccgatcgacctcgaacatggacgtctggggcc

SEQ ID NO: 457070 - DNA, 507 bp, Homo sapiens
  misc_feature: HEFZJCU01DZG1X.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaacgggccggttcaccctctccagagacacttccaacaacatcttgtatcttcacatgcacaatctgagagtcgacgacacggccacctattattgtgcgcgacatgactacgctcaattcgtggggccagggacg

SEQ ID NO: 457071 - DNA, 504 bp, Homo sapiens
  misc_feature: HEFZJCU01BFUQ2.4.9.A09.1.454.heavy.3.raw
agcactgtagcacgaccggtgctcgatttagcgagacgcgcagggggagagaggagcccagccctgggattttcaggtgttttcatttggtgatcaggactgaacagagagaactcaccatggagtttgggctgagctggctttttcttgtggctattttaaaaggtgtccagtgtgaggtgcagttggtggagtctgggggaggcttggtacagcctggggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatctccagagacaattccaagaacacgttatatctgcaaatgaacagcctgcgagccgacgacacggccgtatattactgtgcgaaatgccttattgcgaccgagcgtagcagtggct

SEQ ID NO: 457072 - DNA, 518 bp, Homo sapiens; identical to SEQ ID NO: 451751
  misc_feature: HEFZJCU01CC4MJ.9.34.D01.1.454.heavy.3.raw

SEQ ID NO: 457073 - DNA, 491 bp, Homo sapiens
  misc_feature: HEFZJCU01BY2LF.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacgacccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggactacttccgagtgcgtct

SEQ ID NO: 457074 - DNA, 524 bp, Homo sapiens
  misc_feature: HEFZJCU01E04XQ.49.57.F02.1.454.heavy.3.raw
agtcgagagacacgaccggtgctcgatttagctcgatatagttgggtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaaccctggtcaccgtctcctcagcctccaccaagggcccatcggtcttcccctggcgccctgctccagagcacctccgagagcacagcc

SEQ ID NO: 457075 - DNA, 515 bp, Homo sapiens; identical to SEQ ID NO: 448426
  misc_feature: HEFZJCU01EDSOJ.53.70.G04.1.454.heavy.3.raw

SEQ ID NO: 457076 - DNA, 378 bp, Homo sapiens; identical to SEQ ID NO: 444463
  misc_feature: HEFZJCU01C1X7N.47.77.G11.1.454.heavy.3.raw

SEQ ID NO: 457077 - DNA, 479 bp, Homo sapiens
  misc_feature: HEFZJCU01EVM0L.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggccccat

SEQ ID NO: 457078 - DNA, 529 bp, Homo sapiens
  misc_feature: HEFZJCU01ET8CK.52.38.D05.1.454.heavy.3.raw
cgcagtacgacacgaccggtgctcgatttagtatctgatagttgggtttgggggctctgggagaggagcccagcactgggattccgaggtgtttccattcagtgatctgcactgaacacagaggactcgccatggagtttgggctgagctgggttttccttgttgctattttaaaaggtgtccagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagcccgtaacttctggggccagggaacccgggtcaccgtctcctcagcctccaccaaggcccatcggtcttcccctggccaccctcctccaagagcaccctctc

SEQ ID NO: 457079 - DNA, 491 bp, Homo sapiens; identical to SEQ ID NO: 445531
  misc_feature: HEFZJCU01CGG2A.11.38.D05.1.454.heavy.3.raw

SEQ ID NO: 457080 - DNA, 469 bp, Homo sapiens
  misc_feature: HEFZJCU01BESCM.48.49.E05.1.454.heavy.3.raw
agtatacatacacgaccggtgctcgatttagagcgactagcaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtggtggcacacgctattcacagaagtttcagggcagggtcaccatgaccagggacacgtccatcagcacagcctacatggaattgagcaggctgacatctgacgacacggccgtgtattattgtgcgagag

SEQ ID NO: 457081 - DNA, 515 bp, Homo sapiens
  misc_feature: HEFZJCU01DS5MH.26.12.B01.1.454.heavy.3.raw
agactatactcacgaccggtgctcgatttagtagtgtagattccgcgggggggagaggagccccagccctgagactcccaggtgcttccattcagtgatcagcactgaacacagaggactcaccatggagttgggactgaactggattttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccaggggaggggcctggagtgggtctcaggtatcagttacaatagtggtaatatactctatgcggactctgtgaagggccgattcaccatctccagagacaacgccaggaactccctctatctagaaatggacagtctgacaactgaggacacggccttttattctgtgcaaaggtggaaccgacatatttcacaagctggcactggtacttcg

SEQ ID NO: 457082 - DNA, 506 bp, Homo sapiens; identical to SEQ ID NO: 448223
  misc_feature: HEFZJCU01EHL9M.18.50.E06.1.454.heavy.3.raw

SEQ ID NO: 457083 - DNA, 523 bp, Homo sapiens; identical to SEQ ID NO: 446270
  misc_feature: HEFZJCU01CVPNJ.12.40.D07.1.454.heavy.3.raw

SEQ ID NO: 457084 - DNA, 410 bp, Homo sapiens
  misc_feature: HEFZJCU01CDB80.51.31.C09.1.454.heavy.3.raw
cgatcgtatacacgaccggtgctcgatttagacgtctcatcaaggaaggaaggggctggagtgggtctcaatgatcagtgatggtggaacgaccacaaactacgccgactccgtgaagggccggtgcaccatctccagagacaattcgaaggacactttatatctgcaactcaacagactgacacccgcggacacggccgtctactactgtgtgaaagaagacggaccgctggacgaggagccagaggagaatcactacttgactactggggccagggaagactggtcaccgtctcctccgcctccaccaagggcccatcggtcttccccctggcaccctcctccaagagcacctctgggggcacagcggccctgggctgcctggtcaaggactacttcctcgtagcact

SEQ ID NO: 457085 - DNA, 531 bp, Homo sapiens; identical to SEQ ID NO: 446857
  misc_feature: HEFZJCU01BHIUG.7.78.H01.1.454.heavy.3.raw

SEQ ID NO: 457086 - DNA, 539 bp, Homo sapiens; identical to SEQ ID NO: 447062
  misc_feature: HEFZJCU01ER45Y.16.39.D06.1.454.heavy.3.raw

SEQ ID NO: 457087 - DNA, 496 bp, Homo sapiens; identical to SEQ ID NO: 446282
  misc_feature: HEFZJCU01ETLAE.12.55.E11.1.454.heavy.3.raw

SEQ ID NO: 457088 - DNA, 415 bp, Homo sapiens; identical to SEQ ID NO: 444794
  misc_feature: HEFZJCU01BETL7.14.74.G08.1.454.heavy.3.raw

SEQ ID NO: 457089 - DNA, 490 bp, Homo sapiens; identical to SEQ ID NO: 445139
  misc_feature: HEFZJCU01DRIY0.12.75.G09.1.454.heavy.3.raw

SEQ ID NO: 457090 - DNA, 500 bp, Homo sapiens; identical to SEQ ID NO: 446033
  misc_feature: HEFZJCU01CT8QI.11.27.C05.1.454.heavy.3.raw

SEQ ID NO: 457091 - DNA, 523 bp, Homo sapiens
  misc_feature: HEFZJCU01EDC4Y.5.33.C11.1.454.heavy.3.raw
atcagacacgcacgaccggtgctcgatttagagtgagctcgttgggtttgggggaggcttggtccagcctggggggtccctgagactctcctgtgtagcctccggattcacctttagtgcctattggatgacctgggtccgccaggctccagggaaggggctggagtgggtggccaatataagattcgatggaagtgaggtgtactatgtggactctgtgaagggccgattcaccatctccagagacaacgccgagaactcactgtatctccaaatgaacagcctgagagccgaggacacggctgtctactactgtacgaatatccctcgttttacgatttttggactggcccgttggggtactcctacggtttggacgtctggggccaagggaccacggtcaccgtctcctcagcctccaccaagggcccatcggtcttcccctggcgccctgctccaggagcacctccgagagcacagcggccctgggctgcctggtcaaggactacttcccgtgtctgat

SEQ ID NO: 457092 - DNA, 510 bp, Homo sapiens; identical to SEQ ID NO: 445542
  misc_feature: HEFZJCU01DQNEF.16.21.B10.1.454.heavy.3.raw

SEQ ID NO: 457093 - DNA, 519 bp, Homo sapiens
  misc_feature: HEFZJCU01D0IZY.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctgggccagggaacccaggtcaccgtctcctcagcctccaccaagggcccatccgtcttcccctggcgccctgctccaggagcacctccgagagcacagcggccctgggctgcctggtcaaggactactcctacg

SEQ ID NO: 457094 - DNA, 506 bp, Homo sapiens; identical to SEQ ID NO: 444696
  misc_feature: HEFZJCU01BH456.16.34.D01.1.454.heavy.3.raw

SEQ ID NO: 457095 - DNA, 542 bp, Homo sapiens
  misc_feature: HEFZJCU01ET48J.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggcttttcttgtggctttttaaaaggtgcccagtgtgaggtgcaactgttggagtctgggggaggcttggtacagccgggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggctggatcggggagtttggttcctggggccaggggaaccctggtccg

SEQ ID NO: 457096 - DNA, 374 bp, Homo sapiens; identical to SEQ ID NO: 447434
  misc_feature: HEFZJCU01DOUEV.13.5.A05.1.454.heavy.3.raw

SEQ ID NO: 457097 - DNA, 520 bp, Homo sapiens
  misc_feature: HEFZJCU01BPQJF.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctgggccagggacccaggtcaccgtctcctcagcctccaccaagggcccatccgtcttcccctgcgccctgctccaggagcacctccgagagcacagcggccctgggctgcctggtcaagggactacttcctaccg

SEQ ID NO: 457098 - DNA, 395 bp, Homo sapiens; identical to SEQ ID NO: 444494
  misc_feature: HEFZJCU01A03W3.47.46.E02.1.454.heavy.3.raw

SEQ ID NO: 457099 - DNA, 494 bp, Homo sapiens
  misc_feature: HEFZJCU01EYREF.4.57.F02.1.454.heavy.3.raw
agcactgtagcacgaccggtgctcgatttagctcgatatagttgggttggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctcgtgggggcacgagcggcccgtgggctgcctggtcaaggactacttccctacagtgct

SEQ ID NO: 457100 - DNA, 509 bp, Homo sapiens
  misc_feature: HEFZJCU01CREFP.13.71.G05.1.454.heavy.3.raw
tcacgtactacacgaccggtgctcgatttagtgtcgtcgcaagagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggggcttggtccagcctggggggtccctgagactctcctgtgcagcctctggattcacttttagtaggtattggatgggttgggtccgccagactccagagaagggactggagtgggtggccaacataaaggaagatggaagtgaaagatactatgtggactctgtgaagggccgattcaccatctccagagacaacgccaagaattcactgtatctgcagatgaccagcctgagagtcgaggatacggctgtgtattattgtgcgagagatggggcacgacattttgtagaggtgtactggggccagggac

SEQ ID NO: 457101 - DNA, 491 bp, Homo sapiens; identical to SEQ ID NO: 456439
  misc_feature: HEFZJCU01ELP6E.10.29.C07.1.454.heavy.3.raw

SEQ ID NO: 457102 - DNA, 510 bp, Homo sapiens
  misc_feature: HEFZJCU01BTJVB.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctggggcacagcggccctgggctgcctggtcaaggactacttcccata

SEQ ID NO: 457103 - DNA, 500 bp, Homo sapiens; identical to SEQ ID NO: 454641
  misc_feature: HEFZJCU01AIZM5.10.55.E11.1.454.heavy.3.raw

SEQ ID NO: 457104 - DNA, 324 bp, Homo sapiens
  misc_feature: HEFZJCU01BTU69.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcatcgtctcctcagcctccaccaagggcccatcggtcttccccctggcgccctgctccaggagcacctccgagagcacagcggccctgggctgcctggtcaaggactacttcccatactcgta

SEQ ID NO: 457105 - DNA, 396 bp, Homo sapiens
  misc_feature: HEFZJCU01BSD42.11.62.F07.1.454.heavy.3.raw
cgagagataccacgaccggtgctcgatttagtagtcgcataaagggaaaggggctgcagtgggtctcaggcattggtaccagtgatgataagacacactacgcagactccgtgaagggccgattcaccgtctccagagacaattccaggcacacgctgtatctgcaaatgaacagcctgagagctgaggacacggctgtgtattactgtgcgaaagatttctatagaggtgactacgggggcgtctttgactactgggccagggaaccctggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 457106 - DNA, 519 bp, Homo sapiens
  misc_feature: HEFZJCU01ETUPL.51.80.H03.1.454.heavy.3.raw
  modified_base (473)..(473): a, c, t, g, unknown or other
cgatcgtatacacgaccggtgctcgatttagctgtgcgtcgaagggaaaggggaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaaagtcgaataaccatcaacccagacacatccaagaaccagttctccctgcaactgaactctgtgactcccgaggacacggccgtgtattactgtgcaagaggttggttaacagctggaggatttgactacgtggggccagggaaccctggtcaccgtctcctcagcctccaccgaagggcccagtcggtccttcccctcccggngcccctgcctccaggagccacctccgagacgcacagccggcccgtc

SEQ ID NO: 457107 - DNA, 475 bp, Homo sapiens
  misc_feature: HEFZJCU01C2H8X.10.38.D05.1.454.heavy.3.raw
catagtagtgcacgaccggtgctcgatttagtatctgatagttgggtttggggggaagaggaagactgagggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggccctgggctgcctggtcaaggactacttcccactactatg

SEQ ID NO: 457108 - DNA, 508 bp, Homo sapiens; identical to SEQ ID NO: 446002
  misc_feature: HEFZJCU01ECL00.9.78.H01.1.454.heavy.3.raw

SEQ ID NO: 457109 - DNA, 518 bp, Homo sapiens
  misc_feature: HEFZJCU01BDY9Z.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccggtgaggggccgattcagcatctccagagacaacggcaagagtatactgtatctggaaatgaacaatctgagagtcgacgatacggctgtctatcattgttgttttcgatgccttcggtccggcgggtacttcgtggggccacgggaacccgtc

SEQ ID NO: 457110 - DNA, 509 bp, Homo sapiens
  misc_feature: HEFZJCU01DIVI3.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttccccctggccgccctgctccaggacg

SEQ ID NO: 457111 - DNA, 533 bp, Homo sapiens
  misc_feature: HEFZJCU01ENYLJ.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggtcaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtaggaaaagtaatggctgtgtttattggggccaggggagccctggtcaccgt

SEQ ID NO: 457112 - DNA, 402 bp, Homo sapiens; identical to SEQ ID NO: 446127
  misc_feature: HEFZJCU01A9366.10.77.G11.1.454.heavy.3.raw

SEQ ID NO: 457113 - DNA, 400 bp, Homo sapiens; identical to SEQ ID NO: 444452
  misc_feature: HEFZJCU01BZF76.47.24.C02.1.454.heavy.3.raw

SEQ ID NO: 457114 - DNA, 500 bp, Homo sapiens
  misc_feature: HEFZJCU01CA9UD.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacaggtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtctttttgatgcctttgatatgtggggccagggacaatggtcaccgtct

SEQ ID NO: 457115 - DNA, 407 bp, Homo sapiens
  misc_feature: HEFZJCU01DWH0X.11.67.G01.1.454.heavy.3.raw
cgagagataccacgaccggtgctcgatttagagtatacatattgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggtaactgctacgacgcctactattatcaccacatggacgtctggggcaaagggaccacggtcatcgtctcctcagcctccaccaagggcccatcggtcttccccctggcaccctcctccaagagcacctctgggggcacagcggccctgggctgcctggtcaaggactacttccgtatctctcg

SEQ ID NO: 457116 - DNA, 519 bp, Homo sapiens
  misc_feature: HEFZJCU01D2G2L.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtggggccaagggacc

SEQ ID NO: 457117 - DNA, 426 bp, Homo sapiens
  misc_feature: HEFZJCU01DMFSM.40.81.H04.1.454.heavy.3.raw
tctagcgactcacgaccggtgctcgatttagtagtgtagattcgcgggggtgtgccctgagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatgggggtggatcaaccctaccagaggtggcacaaagtatcgacagaactttcagggcagggtcaccatggcctgggacgcgtccatcagcacagtctacatggat

SEQ ID NO: 457118 - DNA, 519 bp, Homo sapiens
  misc_feature: HEFZJCU01AJ7ZI.48.5.A05.1.454.heavy.3.raw
agtatacatacacgaccggtgctcgatttagatagatagacaggggtctgagagaggagcccagccctgggattttcaggtgttttcatttggtgatcaggactgaacagagagaactcaccatggagtttgggttgagctggctttttcttgtggctattttaaaaggtgtccagtgtgaggtgcagctgttggagtctgggggaggcttggtacagccgggggggtccctgagactctcctgtgcaacctctggattcacctttaggggctatgccatgaactgggtccgccaggttcctgggaagggctggagtgggtctcatctattagtgagactggtgatactacagactacgcagactccgtgaggggccggttcaccgtctccagagacaattccaagaacacgctattctgcaaatgaacagcctgagagtcgacgacacggccgtatactactgtgcgagacagatgctgccgcctgttccgtgggccagggaaccctggtcaccgtct

SEQ ID NO: 457119 - DNA, 497 bp, Homo sapiens; identical to SEQ ID NO: 445179
  misc_feature: HEFZJCU01DYTC9.12.55.E11.1.454.heavy.3.raw

SEQ ID NO: 457120 - DNA, 529 bp, Homo sapiens; identical to SEQ ID NO: 446352
  misc_feature: HEFZJCU01ETV4N.49.31.C09.1.454.heavy.3.raw

SEQ ID NO: 457121 - DNA, 519 bp, Homo sapiens; identical to SEQ ID NO: 444867
  misc_feature: HEFZJCU01E1BQ8.9.34.D01.1.454.heavy.3.raw

SEQ ID NO: 457122 - DNA, 515 bp, Homo sapiens; identical to SEQ ID NO: 447834
  misc_feature: HEFZJCU01AQMJ1.3.20.B09.1.454.heavy.3.raw

SEQ ID NO: 457123 - DNA, 502 bp, Homo sapiens
  misc_feature: HEFZJCU01BQYP8.52.83.H06.1.454.heavy.3.raw
cgcagtacgacacgaccggtgctcgatttagatcacgtgcgtcgcggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctgatgcctccatcagtcgtgacgattactactggagctggatccgccagcccccagggaagggcctggaatggattggctacatcttttacagtgagagcacctcctacaacccgtccctcaagagtcgagttaccatatcagctgacaagtccaagaaccacttctccctgaagctgacctctgtgactgccacagacacggccgtctattactgtgccagagggatcgctagaggtggctccattcgttttagactcctggggccagggaaccctggtcctccgt

SEQ ID NO: 457124 - DNA, 502 bp, Homo sapiens
  misc_feature: HEFZJCU01CMD7B.10.35.D02.1.454.heavy.3.raw
catagtagtgcacgaccggtgctcgatttagcacacgatagttgggtttgggggaggcttggttaagccgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgcctgctccaggagcacctccgagagcacagcggccctgggcgtgcctggtcaggactacttccactacctatg

SEQ ID NO: 457125 - DNA, 535 bp, Homo sapiens
  misc_feature: HEFZJCU01EQAT9.16.87.H10.1.454.heavy.3.raw
  modified_base (480)..(480): a, c, t, g, unknown or other
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccggggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgnggaaacagttatgggttggggggtaggttggggttttttttcgttacgtacgggt

SEQ ID NO: 457126 - DNA, 509 bp, Homo sapiens
  misc_feature: HEFZJCU01CU0C1.53.34.D01.1.454.heavy.3.raw
cgcgtatacacacgaccggtgctcgatttagatcgtctgtgttgggtttggggctgggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccaagaacacactgtttcttcaaatggacttcctgagaactgaggacacggccgtgtattactgcgcgagagtgcatgatagtggtttccatgatgtcttttga

SEQ ID NO: 457127 - DNA, 537 bp, Homo sapiens; identical to SEQ ID NO: 445697
  misc_feature: HEFZJCU01B3NGE.14.57.F02.1.454.heavy.3.raw

SEQ ID NO: 457128 - DNA, 521 bp, Homo sapiens
  misc_feature: HEFZJCU01C7RHM.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcggtcttcccctggcgccctcgctccaggagcacctccgagagcacacgcggccc

SEQ ID NO: 457129 - DNA, 508 bp, Homo sapiens
  misc_feature: HEFZJCU01CGKEI.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaaagtgacgtggtagttccggggggacgacatgacaccg

SEQ ID NO: 457130 - DNA, 498 bp, Homo sapiens
  misc_feature: HEFZJCU01CJ71E.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacacggccctgggcaaggtcttgagtggatgggactaatcactcccaatggtgatgggactgcctacgcacagaagtttcgagggcaggagtcaccatgaccaggggacacgtccacgagaacagactattggagttgagcagcctgagatctgacgacacggccgttttatactgtgcgcgagatatagtcacaactggaacggtcggttttggggt

SEQ ID NO: 457131 - DNA, 512 bp, Homo sapiens
  misc_feature: HEFZJCU01DJK2G.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctgcaaggcttctggctacacctttaccacctatggtgtcaactgggtgcgacaggcccctggacaagggcttgagtggatgggatggatcagcgcttacaatgggaacacaaactatgcacagacgttccagggccagagtcaccattaccacagacacatccacgagcacagcctacatggacctgaggagcctgagatttgacgacacggccactatattactgtgcgagagattgggccgacggaaccttgactactggggccagggaaccctggtcaccgt

SEQ ID NO: 457132 - DNA, 496 bp, Homo sapiens
  misc_feature: HEFZJCU01DDPGN.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctgggccgtggcaccctgctgactgtctcctcagcctccaccaagggcccatcggtcttcccctggcgcctgctccaggagcacctccgagagcacagcggccctgggctgcctggtcaaggactaccg

SEQ ID NO: 457133 - DNA, 520 bp, Homo sapiens
  misc_feature: HEFZJCU01ALWDO.12.40.D07.1.454.heavy.3.raw
atacgacgtacacgaccggtgctcgatttagtgatagagcgtaacaacagagggctcaccatggagtttgggctgagcgtggtttcgtcgtaggctctttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagccctgagaccagacgacacggctgtctattattgcgcgagagagacacacgaacctactggccaatactatgggggcttgttctggggccaggggaccctggtcatcgtctcccagcctcaccaagggcccatcggtcttccccctggcg

SEQ ID NO: 457134 - DNA, 482 bp, Homo sapiens
  misc_feature: HEFZJCU01A7HQM.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctgggctgcctggtcaaggactacttccactactatg

SEQ ID NO: 457135 - DNA, 485 bp, Homo sapiens
  misc_feature: HEFZJCU01ASEJV.19.13.B02.1.454.heavy.3.raw
tactctcgtgcacgaccggtgctcgatttagtctagcgacttccgcggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagccctgagagctgaggacacggctgtgtattactgtgcgaggcggt

SEQ ID NO: 457136 - DNA, 505 bp, Homo sapiens
  misc_feature: HEFZJCU01CVYW6.48.39.D06.1.454.heavy.3.raw
agtatacatacacgaccggtgctcgatttagtgacatctcgcagttctttggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctgggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcagtggcttttgatgcctttgatatgtggggtccaagggacaatggtcaccgtctcttcagcctccacccg

SEQ ID NO: 457137 - DNA, 511 bp, Homo sapiens
  misc_feature: HEFZJCU01DHT0E.48.27.C05.1.454.heavy.3.raw
agtatacatacacgaccggtgctcgatttagacgcgatcgaagggtttggggtctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttggtccgccaggctccaggcaaggggctggagtgggtggctgttgtgtcaaatgatggacatgctgaatatgcagactccgtgaggggccgattcgccttctccagagacaattccaagagcacggttcatctgacaaatgagcgccctgagacctgacgacacggctgtctatactgtgcgagagggcgtccgagttaacacgccgtggggaggatta

SEQ ID NO: 457138 - DNA, 520 bp, Homo sapiens
  misc_feature: HEFZJCU01D32NS.7.78.H01.1.454.heavy.3.raw
cgtgtctctacacgaccggtgctcgatttagtgtgagtagtttggggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggactacttcctagagacacg

SEQ ID NO: 457139 - DNA, 510 bp, Homo sapiens; identical to SEQ ID NO: 448445
  misc_feature: HEFZJCU01CU31Z.16.71.G05.1.454.heavy.3.raw

SEQ ID NO: 457140 - DNA, 482 bp, Homo sapiens; identical to SEQ ID NO: 453533
  misc_feature: HEFZJCU01ER5EL.11.23.C01.1.454.heavy.3.raw

SEQ ID NO: 457141 - DNA, 498 bp, Homo sapiens; identical to SEQ ID NO: 451503
  misc_feature: HEFZJCU01DVMHQ.17.10.A10.1.454.heavy.3.raw

SEQ ID NO: 457142 - DNA, 524 bp, Homo sapiens; identical to SEQ ID NO: 448845
  misc_feature: HEFZJCU01EZ78Y.16.27.C05.1.454.heavy.3.raw

SEQ ID NO: 457143 - DNA, 413 bp, Homo sapiens; identical to SEQ ID NO: 444758
  misc_feature: HEFZJCU01DXFOW.3.71.G05.1.454.heavy.3.raw

SEQ ID NO: 457144 - DNA, 477 bp, Homo sapiens
  misc_feature: HEFZJCU01A4R0J.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccaggggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctggggcacagcggccctgggctgcctggtcaaggactacttccgagtagtaca

SEQ ID NO: 457145 - DNA, 501 bp, Homo sapiens
  misc_feature: HEFZJCU01DNKFP.49.83.H06.1.454.heavy.3.raw
agtcgagagacacgaccggtgctcgatttagatcacgtgcgtcgaaggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctccaagagcacctctgggggcacagcggccctgggctgcctggtcaaggactacttcct

SEQ ID NO: 457146 - DNA, 508 bp, Homo sapiens; identical to SEQ ID NO: 448191
  misc_feature: HEFZJCU01ELCFA.4.67.G01.1.454.heavy.3.raw

SEQ ID NO: 457147 - DNA, 484 bp, Homo sapiens; identical to SEQ ID NO: 446564
  misc_feature: HEFZJCU01BI9EA.19.13.B02.1.454.heavy.3.raw

SEQ ID NO: 457148 - DNA, 492 bp, Homo sapiens
  misc_feature: HEFZJCU01ESA6I.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttagacgagt

SEQ ID NO: 457149 - DNA, 481 bp, Homo sapiens; identical to SEQ ID NO: 450956
  misc_feature: HEFZJCU01CFYCD.19.67.G01.1.454.heavy.3.raw

SEQ ID NO: 457150 - DNA, 497 bp, Homo sapiens
  misc_feature: HEFZJCU01CKBG5.17.86.H09.1.454.heavy.3.raw
cgtagactagcacgaccggtgctcgatttagtgctatagacttgggtttggggtctgggagaggagccccagccctgagattcccaggtgtttccattcagtgatcagcactgaacacagaggactcaccatggagttgggactgagctggattttccttttggctactctaaaaggtgtccagtgtgaagtgcagctggtggagtctgggggaggcttggtacagcctggcaggtccctgagactctcctgtgcagcctctggattcacctttgatgattatggcatgcactgggtccgccaagccccagggaagggcctggagtgggtctcaggcattagttggaatggtggtagcatagcctatgcggactccgtgaagggccgattcaccatctccagagacaacgccgaaaattccctgtatctgcagatgaacagtctgagagctgaagacacggccttatatttctgtgtgaaaccatcacgccacaacg

SEQ ID NO: 457151 - DNA, 513 bp, Homo sapiens
  misc_feature: HEFZJCU01EOH02.4.57.F02.1.454.heavy.3.raw
agcactgtagcacgaccggtgctcgatttagctcgatatagttgggtttggggggaagaggaagactgacggtcctcccaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtcttttgaccagtgggccagggaaccctggtcaccgtctcctcagcttccaccaggccatcggtcttcccctggcgccctgctccaggacgcacctcgtgggggtcacgagcc

SEQ ID NO: 457152 - DNA, 379 bp, Homo sapiens; identical to SEQ ID NO: 444773
  misc_feature: HEFZJCU01EIJ9N.3.59.F04.1.454.heavy.3.raw

SEQ ID NO: 457153 - DNA, 499 bp, Homo sapiens
  misc_feature: HEFZJCU01CAG4S.13.33.C11.1.454.heavy.3.raw
tcacgtactacacgaccggtgctcgatttagagtgagctcgttgggtttggggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaatagaattgcaacgatgcttttgatatgtggggaccg

SEQ ID NO: 457154 - DNA, 326 bp, Homo sapiens
  misc_feature: HEFZJCU01CC2AF.18.17.B06.1.454.heavy.3.raw
tacgagtatgcacgaccggtgctcgatttagtcgatagtgaaggggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactacttcccagtactcgta

SEQ ID NO: 457155 - DNA, 487 bp, Homo sapiens
  misc_feature: HEFZJCU01DN4X8.10.85.H08.1.454.heavy.3.raw
catagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggagtgggtggccaccataaaggaagatggaagtgagaactacttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttccccctggcgccctgctccaggagcacctccgagagcacagcggccctgggctgcctggtcaaggactacttcccactactatg

SEQ ID NO: 457156 - DNA, 522 bp, Homo sapiens
  misc_feature: HEFZJCU01CLSXR.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaagggcataaagtggttcgacccctggggccagggaaccctggtcaccgtctcctcagcctccaccaagggcccatcggtcttcccctggcgccctgctccaggagcacctccgagagcacagcggccctgggc

SEQ ID NO: 457157 - DNA, 535 bp, Homo sapiens
  misc_feature: HEFZJCU01EOBNG.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggattgactacgtggggccagggaaccctggtcaccgtctcctcacgccctccaccgaacggg

SEQ ID NO: 457158 - DNA, 525 bp, Homo sapiens
  misc_feature: HEFZJCU01E1ZB5.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttccccctggcgccctgctccaggagcacctccgagagcacagcggccctgggctgcctggtcaaggactacttcc

SEQ ID NO: 457159 - DNA, 531 bp, Homo sapiens
  misc_feature: HEFZJCU01BS61U.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaacctggtcaccgtctcctcagcctccaccaaggg

SEQ ID NO: 457160 - DNA, 501 bp, Homo sapiens
  misc_feature: HEFZJCU01AF57R.10.38.D05.1.454.heavy.3.raw
catagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattatgtgcgcgacatgactacgctcaattctggggccg

SEQ ID NO: 457161 - DNA, 506 bp, Homo sapiens
  misc_feature: HEFZJCU01AXEE5.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggtccgcggtccggg

SEQ ID NO: 457162 - DNA, 524 bp, Homo sapiens
  misc_feature: HEFZJCU01A6FEC.48.4.A04.1.454.heavy.3.raw
agtatacatacacgaccggtgctcgatttagagtagtgatcaggggagtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtgggctacgacttgacttttggggccagggaaacctaggtcaccgtctccccagcttccaccaacgggcccatcggtccc

SEQ ID NO: 457163 - DNA, 513 bp, Homo sapiens
  misc_feature: HEFZJCU01EGP20.9.33.C11.1.454.heavy.3.raw
tgatacgtctcacgaccggtgctcgatttagagtgagctcgttgggtctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgtac

SEQ ID NO: 457164 - DNA, 470 bp, Homo sapiens
  misc_feature: HEFZJCU01C0PIJ.48.51.E07.1.454.heavy.3.raw
agtatacatacacgaccggtgctcgatttagcatactctacaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtggtggcacacgctattcacagaagtttcagggcagggtcaccatgaccagggacacgtccatcagcacagcctacatggaattgagcaggctgacatctgacgacacggccgtgtatttattgtgcgagag

SEQ ID NO: 457165 - DNA, 491 bp, Homo sapiens; identical to SEQ ID NO: 444592
  misc_feature: HEFZJCU01CG2L2.11.26.C04.1.454.heavy.3.raw

SEQ ID NO: 457166 - DNA, 508 bp, Homo sapiens
  misc_feature: HEFZJCU01A6O0E.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctcggcgccctgctccaggagcacctccgacgagcacagcggccccgttgggcgtcgcctcggtcaaggacacttcctatgtatact

SEQ ID NO: 457167 - DNA, 501 bp, Homo sapiens
  misc_feature: HEFZJCU01DUU53.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctagttaaaactcctactacggtctggacgtc

SEQ ID NO: 457168 - DNA, 479 bp, Homo sapiens
  misc_feature: HEFZJCU01DWHDP.40.83.H06.1.454.heavy.3.raw
tctagcgactcacgaccggtgctcgatttagatcacgtgcgtcgcgggggggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctggggaggtcactgagactctcctgtgcatcgtccggattcaccttccataaatataacatgcactgggtccgccaggctccaggcaagggactgcagtggctggccactgtctggtcggatgaaagttatgcatactatgcagactctctgaggggccgattcatcatctctagagacaattcgaagaacacggcttatctgcaaatgaacagcctgacagtcgaggacacggctgtatatttctgtgcgaatgagga

SEQ ID NO: 457169 - DNA, 505 bp, Homo sapiens
  misc_feature: HEFZJCU01AXRZD.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgtgtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggagtacagtggcagctccaagtac

SEQ ID NO: 457170 - DNA, 499 bp, Homo sapiens
  misc_feature: HEFZJCU01CJUZJ.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggagcttggtacagcctggcaggtccctgagactctcctgtgcagcatctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagatccaaccccttacg

SEQ ID NO: 457171 - DNA, 519 bp, Homo sapiens
  misc_feature: HEFZJCU01CJVOP.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaagggaggggggaaccgagcgggagttccaagtactcctttgacgtctc

SEQ ID NO: 457172 - DNA, 515 bp, Homo sapiens
  misc_feature: HEFZJCU01CJGQR.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtggggaccg

SEQ ID NO: 457173 - DNA, 514 bp, Homo sapiens
  misc_feature: HEFZJCU01AF3JZ.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctggggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtaacgaaggagggggaaccaggcgggagtccaagtactcctttg

SEQ ID NO: 457174 - DNA, 502 bp, Homo sapiens
  misc_feature: HEFZJCU01EUGWD.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactac

SEQ ID NO: 457175 - DNA, 534 bp, Homo sapiens
  misc_feature: HEFZJCU01DP3XZ.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagcgtggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatccctgaaagcgtcaactactactactacggtatggacctctgggg

SEQ ID NO: 457176 - DNA, 521 bp, Homo sapiens
  misc_feature: HEFZJCU01A6ZPR.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctggggccaggggaccctggtcatcgtctccccagcctccaccaagggcccatcggtcttccccctggcg

SEQ ID NO: 457177 - DNA, 490 bp, Homo sapiens; identical to SEQ ID NO: 450376
  misc_feature: HEFZJCU01EMEKG.18.70.G04.1.454.heavy.3.raw

SEQ ID NO: 457178 - DNA, 501 bp, Homo sapiens; identical to SEQ ID NO: 445341
  misc_feature: HEFZJCU01CRUSD.48.34.D01.1.454.heavy.3.raw

SEQ ID NO: 457179 - DNA, 518 bp, Homo sapiens
  misc_feature: HEFZJCU01B708P.10.79.H02.1.454.heavy.3.raw
  modified_base (508)..(508): a, c, t, g, unknown or other
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctgggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcncctggttatt

SEQ ID NO: 457180 - DNA, 502 bp, Homo sapiens; identical to SEQ ID NO: 451675
  misc_feature: HEFZJCU01B0ZGP.51.78.H01.1.454.heavy.3.raw

SEQ ID NO: 457181 - DNA, 507 bp, Homo sapiens; identical to SEQ ID NO: 446827
  misc_feature: HEFZJCU01CF98Z.10.38.D05.1.454.heavy.3.raw

SEQ ID NO: 457182 - DNA, 471 bp, Homo sapiens
  misc_feature: HEFZJCU01D6UDN.22.56.F01.1.454.heavy.3.raw
acatacgcgtcacgaccggtgctcgatttagcagacgtctgtcggggttctcattcaccactgcttcagtgggtgtgggctggatccgtcagcccccaggaaaggccctggagtggcttgcactcctttatggggatggcggtgaacactacagtccatctctgaagaccagactcaccatcgcccgggacacctccaagaaccaagtggtccttacactgaccagcgtggaccctgtggacacaacaacatatttctgtgcacagagccgccagttagactgggggcctgtcgtggtggttggtgccgcaatgatgcatttcatatttggggccaagggacagtggtcaccgtctcggcagcctccaccaagggcccatcggtcttccccctggcgccctgctccaggagcacctccgagagcacagcggccctgggctgcctggtcaaggactacttccacgcgtatgt

SEQ ID NO: 457183 - DNA, 522 bp, Homo sapiens
  misc_feature: HEFZJCU01ASJS0.16.35.D02.1.454.heavy.3.raw
tgtactactccacgaccggtgctcgatttagcacacgatagttgggtttggggctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaagcccggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctggaggcctcggacaccgccatactattactgtgcgagtccggttatcgccgcagatcactactactactacggtctgggacgtctggggccaaggggacccg

SEQ ID NO: 457184 - DNA, 502 bp, Homo sapiens
  misc_feature: HEFZJCU01EXNPJ.48.59.F04.1.454.heavy.3.raw
agtatacatacacgaccggtgctcgatttagtacacacacttagggattggggtctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgtatgcctttgatatgtggggccaagggacaatggtcaccgtct

SEQ ID NO: 457185 - DNA, 537 bp, Homo sapiens
  misc_feature: HEFZJCU01CQJF4.40.27.C05.1.454.heavy.3.raw
tctagcgactcacgaccggtgctcgatttagacgcgatcgaagggtttgggggcagggtgtacacctgtggttcttcctcctgctggtgtcggctcccagatgggtcctgtcccagttgcagttgcaggagtcgggcccaggactggtgaagacttcggagaccctgtccctcacgtgcactgtctctggtggctccatccgcaatcgtcgattctattgggctgggtccgccggccccagggaaggggctggagtggattgcgagcatatattatgatgagagcgccctctacaacccccccctctacaacccctccctcaagagtcgggtcaccatatctatagacacgtccaacagtcaattctccctggacttgacctctgtgaccgccgcagacacggctgtatattcctgtgcgacccacggaggggatggccccaaatctgcctactttgaccactggggccagggaaccttggtcaccgtctcctcagcctccaccaagggcccatcggtcttccccctggccgccctg

SEQ ID NO: 457186 - DNA, 518 bp, Homo sapiens
  misc_feature: HEFZJCU01DMZ1T.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttctcaaatgaacagcctgagagccgatgacacggccgtgtattactgtgcgagagatggggcccagaacgttactacgctatggacgtcgtggggccaagggacccg

SEQ ID NO: 457187 - DNA, 509 bp, Homo sapiens
  misc_feature: HEFZJCU01CLP8I.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcgtgtaggtacgtttagaagtgtcagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgattcaccatctccagagacaacgccaagaattcactgtatttgcaaatgaacagcctgagaggcgaggacacggccgtgtattattgtgcgcgagatgatagtagactctacagtagcaggtggta

SEQ ID NO: 457188 - DNA, 517 bp, Homo sapiens
  misc_feature: HEFZJCU01CJNX3.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagacaggctcaccatcaccaaggacacctccacaaaccaggtggtccttacaatgaccaatatggaccctgtggacacagccacatattactgttcacgctctatggttcggggagttattagtccctactttgactactggggccagggactctggtcaccgtctccgcagcctccaccaacgggcccagtcc

SEQ ID NO: 457189 - DNA, 516 bp, Homo sapiens
  misc_feature: HEFZJCU01CJU64.10.53.E09.1.454.heavy.3.raw
catagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccggttcggggccgattcaccatctccaaagacaatttgaagaacacgctgtttctgcaatgaacagcctgagagctgaggacacggctgtgtattactgttcgtttggttctgactcggtcggggaactaccttcagcacgtc

SEQ ID NO: 457190 - DNA, 409 bp, Homo sapiens
  misc_feature: HEFZJCU01EZ0QZ.49.62.F07.1.454.heavy.3.raw
agtcgagagacacgaccggtgctcgatttagtagtcgcataaagggaaaggggctggagtggctttcatatatcagcagtagtggtagcaccatcttctacgcagactctgtgaagggccgattcaccatttcccgggacaacgccaagaagtcactatctctgcacatgatcagcctgagagccgaggacacggccatgtatttctgtgcgagagcccctcacggtggtgggactgtaccttattacttctacgctatggacgtctggggccaagggaccacggtcaccgtctcctcaccctccaccaagggcccatcggtcttccccctggcaccctcctccaagagcacctctgggggcacagcggccctgggctgcctggtcaaggactacttcctctctcgact

SEQ ID NO: 457191 - DNA, 495 bp, Homo sapiens
  misc_feature: HEFZJCU01DEZCE.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaatgaccagcctgagagccgaggacacgggtgtttattactgtgggagaaatcctagtggcta

SEQ ID NO: 457192 - DNA, 538 bp, Homo sapiens
  misc_feature: HEFZJCU01BK0BD.48.12.B01.1.454.heavy.3.raw
agtatacatacacgaccggtgctcgatttagtagtgtagattccgcgggggctttctgagagtcatggatctcatgtgcaagaaaatgaagcacctgtggttcttcctcctgctggtggcgtctcccagatgggtcctgtcccagctgcacctgcaggagtcgggcccaggactggtgaggccttcggagaccctgtccctcacctgcactgtctctggtgactccatcaacagtggtactttttactactggggctggatccgccagaccccagggaagggtctggagtggattgggagtgtctattctagtgggaacacccactacaatccgtccctcaagagtcgagtcaccatatccgtggacacgtccaagaacgagttctccctgaggttacaatctgtgaccgccgcagacacggctgtatattactgtgcgagacaccgggagggggcttacgtatggtatcggggcgggagttacttactttgtactacgtggggccgaggggacgtccgtggtcgtaccgtctccctc

SEQ ID NO: 457193 - DNA, 503 bp, Homo sapiens
  misc_feature: HEFZJCU01BXHET.17.25.C03.1.454.heavy.3.raw
cgtagactagcacgaccggtgctcgatttagtagtgtagatttgggtttgggggaccatatttggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggt

SEQ ID NO: 457194 - DNA, 506 bp, Homo sapiens; identical to SEQ ID NO: 445682
  misc_feature: HEFZJCU01DLLU8.48.44.D11.1.454.heavy.3.raw

SEQ ID NO: 457195 - DNA, 505 bp, Homo sapiens
  misc_feature: HEFZJCU01BATJX.13.55.E11.1.454.heavy.3.raw
tcacgtactacacgaccggtgctcgatttagcactcgcacgttgggtttggggggtctcagagaggagccttagccctggactccaaggcctttccacttggtgatcagcactgagcacagaggactcaccatggaattggggctgagctgggtgctccttgttgctattttagaaggtggccagtgtgagatgcgactggtggagtctgggggaggcttggtccagccgggggggtcactgagactctcctgtacagcctcgagattcattttcaggaattattggatgagttgggtccgccagtctccagggaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgttgcgagaattgactagtttccagacggcg

SEQ ID NO: 457196 - DNA, 530 bp, Homo sapiens
  misc_feature: HEFZJCU01EUKJO.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggccgcccgtcg

SEQ ID NO: 457197 - DNA, 512 bp, Homo sapiens
  misc_feature: HEFZJCU01DXH8V.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttccccctggcaccctcctccaagagcacctctgggggcacagcggccctgggctgcctggtcaaggactacttccgagtgcgct

SEQ ID NO: 457198 - DNA, 523 bp, Homo sapiens
  misc_feature: HEFZJCU01DVVH3.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcacctggttctacttcgatctctggggccgt

SEQ ID NO: 457199 - DNA, 493 bp, Homo sapiens
  misc_feature: HEFZJCU01BDWPO.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctcccagagacaattccatgaacacgctgtatctgcaaatgaacagcctgagagccgaggacacggccgtatattactgtgcgcagatagattgtagtggttgtagctgctactggggccagggaaccctggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 457200 - DNA, 505 bp, Homo sapiens
  misc_feature: HEFZJCU01CTL85.17.78.H01.1.454.heavy.3.raw
cgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcactgggtacgccaggcccccggacacagccttgagtggatgggatggatgaacgttgacaatgggaatacgagatattcacagaaattccagggcagagtcaccattaccagggacacatccgcgaacacagcctacatggagctgacgggctgacatctgaagacacggctttatattactgtgcgcgagatggctggcacagagggcacaactggctcgtacccccg

SEQ ID NO: 457201 - DNA, 501 bp, Homo sapiens; identical to SEQ ID NO: 447123
  misc_feature: HEFZJCU01CUQZR.3.20.B09.1.454.heavy.3.raw

SEQ ID NO: 457202 - DNA, 518 bp, Homo sapiens
  misc_feature: HEFZJCU01EOFVT.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccg

SEQ ID NO: 457203 - DNA, 461 bp, Homo sapiens; identical to SEQ ID NO: 450352
  misc_feature: HEFZJCU01AO8AH.4.6.A06.1.454.heavy.3.raw

SEQ ID NO: 457204 - DNA, 490 bp, Homo sapiens; identical to SEQ ID NO: 448990
  misc_feature: HEFZJCU01D31JQ.11.26.C04.1.454.heavy.3.raw

SEQ ID NO: 457205 - DNA, 496 bp, Homo sapiens
  misc_feature: HEFZJCU01AQ8M8.51.29.C07.1.454.heavy.3.raw
cgatcgtatacacgaccggtgctcgatttagagtgctacgaagggaaaggggacagtgagtctccctcactgcccagctgggatctcagggcttcattttctgtcctccaccatcatggggtcaaccgccatcctcgccctcctcctggctgttctccaaggagtctgtgccgaggagcagctggtgcagactggaacagaggtgaaaagccgggggagtctctgaagatctcctgtaagggttctggacacagctttatcaactactggatcggctgggtgcgccagatgcccgggaaaggcctggagtggatgggcatcatctatcctggtgactctgatgtcagatacagcccgtccttccgcggccaggtcaccttctcagccgacaagtccatcgacaccgtctacctgcagtggagcagcctgaaggcctcggacaccgccatgtattactgtgcgagacagacaagagacggctacaatttggcttttg

SEQ ID NO: 457206 - DNA, 515 bp, Homo sapiens
  misc_feature: HEFZJCU01C51NK.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaacccaggtggtccttacaatgaccaatatggaccctgtggacacagccacatattactgttcacgctctatggttcggggagttattagtccctactttgactactggggccaggggaactctggtcaccgtctccgcagcctccaccaagggccc

SEQ ID NO: 457207 - DNA, 506 bp, Homo sapiens
  misc_feature: HEFZJCU01BWCYV.10.38.D05.1.454.heavy.3.raw
catagtagtgcacgaccggtgctcgatttagtatctgatagttgggttttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggacg

SEQ ID NO: 457208 - DNA, 518 bp, Homo sapiens
  misc_feature: HEFZJCU01A0EC9.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccaggggaggggctggagtgggtctcagttatttacaattctggtacccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctc

SEQ ID NO: 457209 - DNA, 497 bp, Homo sapiens
  misc_feature: HEFZJCU01EEO40.51.43.D10.1.454.heavy.3.raw
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccatatatttctgtgcgcgaggaatttcgacttctggataattacttgggttggaact

SEQ ID NO: 457210 - DNA, 521 bp, Homo sapiens
  misc_feature: HEFZJCU01B8Z1N.4.14.B03.1.454.heavy.3.raw
agcactgtagcacgaccggtgctcgatttagtgtgagtagttccgcgggggagagaggagccttagccctggattccaaggcctatccacttggtgatcagcactgagcaccgaggattcaccatggaactggggctccgctgggttttccttgttgctctttttggaggtgtccagtgtgaggtacaactggtggactctgggggaggcctggtcaggcctggggggtccctgagactctcctgtgcagcctctggattcaccttcggaaactatcacatgaactgggtccgccaggctccagggaaggggctggagtgggtctcctgtattagtagtgccggcacttacacatactatgcagactcagtgaagggccgattcaccatctccagagacaacgccaagaactcactgtttcttcaaatggacagcctcagagtcgacgacacggctgtgtattactgtgcgagagcggttagtggtggttacttccggggcaactggggccagggaaccct

SEQ ID NO: 457211 - DNA, 491 bp, Homo sapiens; identical to SEQ ID NO: 445531
  misc_feature: HEFZJCU01BFBA6.11.38.D05.1.454.heavy.3.raw

SEQ ID NO: 457212 - DNA, 513 bp, Homo sapiens
  misc_feature: HEFZJCU01B9KM4.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgtttcacgctctatggttcggggagttattagtccctactttgactactggggccagggaactctggtcaccgtctccgcagcctccaccaaggccc

SEQ ID NO: 457213 - DNA, 510 bp, Homo sapiens
  misc_feature: HEFZJCU01CGS1P.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactggggccagggaacctggtcgtccg

SEQ ID NO: 457214 - DNA, 396 bp, Homo sapiens; identical to SEQ ID NO: 444469
  misc_feature: HEFZJCU01A3F6L.47.46.E02.1.454.heavy.3.raw

SEQ ID NO: 457215 - DNA, 504 bp, Homo sapiens
  misc_feature: HEFZJCU01A5VR1.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactgggccaggcaccctggtcaccgtctcctcagcttccaccaaggccatcggtcttcccctggcgccctgctccaggagcacctctggggcacagcggccctgggctgcctggtcaaggactactccata

SEQ ID NO: 457216 - DNA, 522 bp, Homo sapiens
  misc_feature: HEFZJCU01CC25C.12.40.D07.1.454.heavy.3.raw
atacgacgtacacgaccggtgctcgatttagtgatagagcgtaacaacagagggctcaccatggagtttgggctgagcgtgggtttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggccg

SEQ ID NO: 457217 - DNA, 483 bp, Homo sapiens; identical to SEQ ID NO: 444639
  misc_feature: HEFZJCU01A0AJM.11.23.C01.1.454.heavy.3.raw

SEQ ID NO: 457218 - DNA, 509 bp, Homo sapiens; identical to SEQ ID NO: 444586
  misc_feature: HEFZJCU01DECUZ.12.78.H01.1.454.heavy.3.raw

SEQ ID NO: 457219 - DNA, 487 bp, Homo sapiens; identical to SEQ ID NO: 445219
  misc_feature: HEFZJCU01DRE3V.10.85.H08.1.454.heavy.3.raw

SEQ ID NO: 457220 - DNA, 519 bp, Homo sapiens; identical to SEQ ID NO: 446228
  misc_feature: HEFZJCU01DX54W.9.43.D10.1.454.heavy.3.raw

SEQ ID NO: 457221 - DNA, 490 bp, Homo sapiens
  misc_feature: HEFZJCU01AHEIY.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcaggactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctggtcaaggactacttcctacgtgagct

SEQ ID NO: 457222 - DNA, 534 bp, Homo sapiens
  misc_feature: HEFZJCU01CCKMJ.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgagggccgattcaccatctccagagacaattccaagaacacgctgttcttcaaatgaacagcctgagagccgatgacacggccgtgtattactgtgcggagagagtcgggacccaacggtaaccgttactaccgctagtacggtacgtcggtcggggaccgaacgggaccc

SEQ ID NO: 457223 - DNA, 510 bp, Homo sapiens
  misc_feature: HEFZJCU01ESAW5.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagccccaggaaaggccctggagtggcttgcgctcatttattgggatgagagtaagcactacagtccgtctctgaagaacaggctcaccatcaccaaggacaacctccacaaaccaggtggtccttacaatgaccaatatggaccctgtggacacagccacatattactgttcacgctctatggttcggggagttattagtccctactttgactactgggccagggaactctggtcacgtctccgcagcctccaccaaggccc

SEQ ID NO: 457224 - DNA, 516 bp, Homo sapiens
  misc_feature: HEFZJCU01A9739.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggagggggaaccagcgggagttccaagtacttcc

SEQ ID NO: 457225 - DNA, 541 bp, Homo sapiens
  misc_feature: HEFZJCU01DOUP5.53.65.F10.1.454.heavy.3.raw
cgcgtatacacacgaccggtgctcgatttagctacgctctaaggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcagttgttggagtctgggggaggcttgatacagcctggggggtccctgagactctcctgtgcagcctctggattcacctataacagtcacgccatgaactgggtccgccaggctcccgggaagggctggagtgggtctcaggtattagtggcagtggtggaatcacatactacgcagactccgtgaagggccggttcaccatctccagagacaactccaagaacacactgttctacaaatgaatagcctgagagccggcggacacggccgtatattattgtgcgtaaaggtttgggggttggcaagttggagttgggtttttaagtatcccgtattgtactacgtgggggccgtac

SEQ ID NO: 457226 - DNA, 511 bp, Homo sapiens
  misc_feature: HEFZJCU01CARFP.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttctagtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactacttttgactactggggccg

SEQ ID NO: 457227 - DNA, 514 bp, Homo sapiens
  misc_feature: HEFZJCU01E2D3I.9.70.G04.1.454.heavy.3.raw
tgatacgtctcacgaccggtgctcgatttagtgtagtgtgaagggaaagggcctgtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctgggccaggggaccaaggtcaccgtctcctcagcctccaccaagggcccatcggtcttcccctggcgccctgctccaggagcacctcccgagagcacagcggccctgggctgcctggtcaaggactacttccagacgtatca

SEQ ID NO: 457228 - DNA, 498 bp, Homo sapiens; identical to SEQ ID NO: 445952
  misc_feature: HEFZJCU01B8MJ3.11.71.G05.1.454.heavy.3.raw

SEQ ID NO: 457229 - DNA, 503 bp, Homo sapiens
  misc_feature: HEFZJCU01BZH65.19.86.H09.1.454.heavy.3.raw
tactctcgtgcacgaccggtgctcgatttagtgctatagacttgggtttggggagcatcacccagcaaccacatctgtcctctagagaatcccctgagagctccgttcctcaccatggactggacctggaggatcctcctcttggtggcagcagccaccggagcccactcccaggtgcagctggcgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacgggggctaaagggcataaagtggttcgacccc

SEQ ID NO: 457230 - DNA, 509 bp, Homo sapiens
  misc_feature: HEFZJCU01DJ4J3.49.20.B09.1.454.heavy.3.raw
agtcgagagacacgaccggtgctcgatttagtgtagtgtgaaggggacccaacaaccacatccctcctcagaagccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatggatcaccgctggcaatggtgacacaaaatattcagagaagttccagggcagagtctccattaccagggacacagctgcgagtacagggtacatggaactgagtggcctgagatctgaggacacggctgtttatactgtgcgagagggaagtgggatattgtggcagctccgaggtgcccagccggggcccctactttcgactacgtc

SEQ ID NO: 457231 - DNA, 501 bp, Homo sapiens
  misc_feature: HEFZJCU01DB8DT.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggactttcg

SEQ ID NO: 457232 - DNA, 508 bp, Homo sapiens
  misc_feature: HEFZJCU01EV5NV.8.34.D01.1.454.heavy.3.raw
ctcgcgtgtccacgaccggtgctcgatttagatcgtctgtgtcggctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactcgtgaagggccgattcaccatctccagagacaattcaggaacacaatgtatttggagctgaacagcctaagtcctgaggacacgggcgtatactactgtacgaaggaggggggaaccaggcggagttccaagtactcctttg

SEQ ID NO: 457233 - DNA, 490 bp, Homo sapiens
  misc_feature: HEFZJCU01DZ9DP.19.53.E09.1.454.heavy.3.raw
  modified_base (430)..(430): a, c, t, g, unknown or other
tactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggancacctccgagagcacagcggccctgggctgcctggtcaaggactacttcccacgagagta

SEQ ID NO: 457234 - DNA, 522 bp, Homo sapiens
  misc_feature: HEFZJCU01BAHM1.5.33.C11.1.454.heavy.3.raw
atcagacacgcacgaccggtgctcgatttagagtgagctcgttgggtttgggggaggcttggtccagcctggggggtccctgagactctcctgtgtagcctccggattcacctttagtgcctattggatgacctgggtccgccaggctccagggaaggggctggagtgggtggccaatataagattcgatggaagtgaggtgtactatgtggactctgtgaagggccgattcaccatctccagagacaacgccgagaactcactgtatctccaaatgaacagcctgagagccgaggacacggctgtctactactgtacgaatatcccctcgttttacgatttttggactggcccgttggggtactcctacggtttggacgtctggggccaagggaccacggtcaccgtctcctcagcctccaccaagggcccatcggtcttcccctggcgccctgctccaggagcacctccgagagcacagcggccctgggctgcctggtcaaggactactccgtgtctgat

SEQ ID NO: 457235 - DNA, 525 bp, Homo sapiens
  misc_feature: HEFZJCU01CVL8L.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatgggggcccacgaacgttactacgtctatgggacgtctgggggccaaggggacccg

SEQ ID NO: 457236 - DNA, 374 bp, Homo sapiens
  misc_feature: HEFZJCU01EFJBU.48.59.F04.1.454.heavy.3.raw
agtatacatacacgaccggtgctcgatttagtacacacacttagggattgggagtatttaccacagtgggagcacctactacaacccgtccctcaaaagtcgaggcaccatatccgtagacacgtccaagaaccaattctccctgaagctgagctctgtgaccgccgcagacacggcggtctattactgtgcgaggcccgagcgcagtggctttttgatgcctttgatatgtggggccaagggacaatggtcaccgtctcttcagcctccaccaagggcccatcggtcttccccctggcaccctcctccaagagcacctctgggggcacagcggccctgggctgcctggtcaaggactacttcctatgtatact

SEQ ID NO: 457237 - DNA, 512 bp, Homo sapiens; identical to SEQ ID NO: 445688
  misc_feature: HEFZJCU01D8Y0S.3.34.D01.1.454.heavy.3.raw

SEQ ID NO: 457238 - DNA, 492 bp, Homo sapiens; identical to SEQ ID NO: 444695
  misc_feature: HEFZJCU01COUUY.3.34.D01.1.454.heavy.3.raw

SEQ ID NO: 457239 - DNA, 533 bp, Homo sapiens
  misc_feature: HEFZJCU01DVVZQ.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggcccggggaaccctgggtcaccgtctccccaccctcccg

SEQ ID NO: 457240 - DNA, 535 bp, Homo sapiens; identical to SEQ ID NO: 452844
  misc_feature: HEFZJCU01DR1W3.11.10.A10.1.454.heavy.3.raw

SEQ ID NO: 457241 - DNA, 511 bp, Homo sapiens
  misc_feature: HEFZJCU01EVGVS.52.83.H06.1.454.heavy.3.raw
cgcagtacgacacgaccggtgctcgatttagatcacgtgcgtcgcggggtctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttatatcaaatgatggaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaaccccgtccgacg

SEQ ID NO: 457242 - DNA, 506 bp, Homo sapiens
  misc_feature: HEFZJCU01CP00U.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggagtacagtggcagctccaagtacta

SEQ ID NO: 457243 - DNA, 506 bp, Homo sapiens; identical to SEQ ID NO: 448333
  misc_feature: HEFZJCU01EF5OP.10.88.H11.1.454.heavy.3.raw

SEQ ID NO: 457244 - DNA, 506 bp, Homo sapiens; identical to SEQ ID NO: 452514
  misc_feature: HEFZJCU01CZOEG.51.56.F01.1.454.heavy.3.raw

SEQ ID NO: 457245 - DNA, 506 bp, Homo sapiens; identical to SEQ ID NO: 445682
  misc_feature: HEFZJCU01BGANE.48.44.D11.1.454.heavy.3.raw

SEQ ID NO: 457246 - DNA, 408 bp, Homo sapiens
  misc_feature: HEFZJCU01CIFJA.40.22.B11.1.454.heavy.3.raw
tctagcgactcacgaccggtgctcgatttagacgacagctcagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtatattactgtgcgagagagccaggtggctacaattggagatactactactactacggtatggacgtctggggccaagggaccacggtctccgtctcctcagcttccaccaagggcccatcggtcttccccctggccgccctgctccaggagcacctctgggggcacagcggccctgggctgcctggtcaaggactacttccagtcgctaga

SEQ ID NO: 457247 - DNA, 375 bp, Homo sapiens; identical to SEQ ID NO: 451721
  misc_feature: HEFZJCU01CIKWE.49.37.D04.1.454.heavy.3.raw

SEQ ID NO: 457248 - DNA, 512 bp, Homo sapiens; identical to SEQ ID NO: 450914
  misc_feature: HEFZJCU01C2BXV.15.67.G01.1.454.heavy.3.raw

SEQ ID NO: 457249 - DNA, 477 bp, Homo sapiens; identical to SEQ ID NO: 451758
  misc_feature: HEFZJCU01C6K1X.16.71.G05.1.454.heavy.3.raw

SEQ ID NO: 457250 - DNA, 495 bp, Homo sapiens
  misc_feature: HEFZJCU01BSX4A.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaaggcccatcggtcttcccctggcgccctgctccaggagcacctctgggggcacagcggccctggctgcctggtcaaggactacttcctacgtcgtat

SEQ ID NO: 457251 - DNA, 503 bp, Homo sapiens
  misc_feature: HEFZJCU01ECJTK.10.34.D01.1.454.heavy.3.raw
catagtagtgcacgaccggtgctcgatttagatcgtctgtgttgggtttggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccaggaaggggctggagtgggttggccatattaaaatcaaagctgatggtgggacaacagagcacgctgcacccgtgaaaggcagattcagcatctcaagagatgattcaaaagtacgctgtatctgaacatgaacagcctagaaaacggaggacacagccgtagtattactgtgccactcaggaccgataattgtt

SEQ ID NO: 457252 - DNA, 484 bp, Homo sapiens; identical to SEQ ID NO: 446564
  misc_feature: HEFZJCU01DO2DB.19.13.B02.1.454.heavy.3.raw

SEQ ID NO: 457253 - DNA, 512 bp, Homo sapiens
  misc_feature: HEFZJCU01B7H3Q.52.36.D03.1.454.heavy.3.raw
cgcagtacgacacgaccggtgctcgatttagctgcgtcacgatctctcttggggtctctgggagaggagctccagccttgggattcccagctgtctccactcggtgatcggcactgaaaacaggagactcagtatggagtttgggctgagcgtgggttttccgttgttagctattttaaaaggtgtccagtgtgagatgcagctggtggagtctggggaggcttggtccagcctggggggtccctgaaactctcctgtacagcctctgggttccccttcagtggcactgctatgcactgggtccgccaggtttccgggaaagggctggagtgggttggccgcatcagaggcaaggcaaaaagtcacgcgacggcatatgctgcgtcggtgaaaggcaggttcaccatctccagagatgattcagataacacggcgtatctgcaatgaacaactgaaacgaagacacggccgtgtattattgtagtagacattcggggggttctggaagtgcc

SEQ ID NO: 457254 - DNA, 514 bp, Homo sapiens
  misc_feature: HEFZJCU01CZHUY.26.12.B01.1.454.heavy.3.raw
agactatactcacgaccggtgctcgatttagtagtgtagattccgcgggggggagaggagccccagccctgagactcccaggtgcttccattcagtgatcagcactgaacacagaggactcaccatggagttgggactgaactggatttttccttttgaccattttaaaaggtgtccagtgtgaagggcagctggtggagtctgggggagacttggtccagcctggcaagtccctaagactctcctgtgtcgcttctggattcacctttgatgaatatgccatgcactgggtccgtcaggcaccagggagggcctggagtgggtctcaggtatcagttacaatagtggtaatatactctatgcggactctgtgaagggccgattcaccatctccagagacaacgccaggaactccctctatctagaaatggacagtctgacaactgaggacacggccttttattctgtgcaaaggtggaaccgacatatttcacaagctggcactggtacttcg

SEQ ID NO: 457255 - DNA, 376 bp, Homo sapiens
  misc_feature: HEFZJCU01ARJMQ.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaaggccatcggtcttcccctggcgccctgctccaggagcacctctgggggcacagcggccctgggctgcctggtcaaggactacttcctacgtgagct

SEQ ID NO: 457256 - DNA, 501 bp, Homo sapiens
  misc_feature: HEFZJCU01DJCMM.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgcctgctccagagcacctctggggc

SEQ ID NO: 457257 - DNA, 500 bp, Homo sapiens
  misc_feature: HEFZJCU01BITZM.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaaggcccatcggtcttccctggcgccctgctccaggagcacctccgagagcacagcggccctgggctgcctggtcaaggactacttcccacta

SEQ ID NO: 457258 - DNA, 511 bp, Homo sapiens
  misc_feature: HEFZJCU01ELMDX.13.39.D06.1.454.heavy.3.raw
tcacgtactacacgaccggtgctcgatttagtgacatctcgcagttctttggggactttctgagagtcctggacctcctgtgcaagaacatgaaacatctgtggttcttcctcctcctggtggcagctcccagatgggtcctgtcccaggtgcagctgcaggagtcgggcccaggactggtgaggccttcacagaccctgtccctcatctgcagtgtctctggtggctccttcagcagtggtagtttctactggagctggatccggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacgggtcaccgtctcctcagcctccaccaagggccccatcc

SEQ ID NO: 457259 - DNA, 513 bp, Homo sapiens
  misc_feature: HEFZJCU01C1GNT.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccgagcgggagttcaagtactcctttg

SEQ ID NO: 457260 - DNA, 379 bp, Homo sapiens; identical to SEQ ID NO: 444450
  misc_feature: HEFZJCU01DSSMY.47.77.G11.1.454.heavy.3.raw

SEQ ID NO: 457261 - DNA, 517 bp, Homo sapiens
  misc_feature: HEFZJCU01CFS5U.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggctacttcctagagacacg

SEQ ID NO: 457262 - DNA, 501 bp, Homo sapiens
  misc_feature: HEFZJCU01AGP64.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggcccatcggtcttcccctggcgccctgctccaggagcacctccgagagcacagcggcccgtgggctgcctggtcaaggactacttcctacgtcgtat

SEQ ID NO: 457263 - DNA, 513 bp, Homo sapiens
  misc_feature: HEFZJCU01DWO88.13.21.B10.1.454.heavy.3.raw
tcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctgggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttggggccggggaaccctggtcaccgtcaa

SEQ ID NO: 457264 - DNA, 513 bp, Homo sapiens
  misc_feature: HEFZJCU01CDYST.49.81.H04.1.454.heavy.3.raw
  modified_base (500)..(500): a, c, t, g, unknown or other
agtcgagagacacgaccggtgctcgatttagtagtgtagattcgcgggggctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttattactgtgcgaacttaatcacggaggacaagggtnacccccggtcacg

SEQ ID NO: 457265 - DNA, 528 bp, Homo sapiens
  misc_feature: HEFZJCU01CENLO.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggccgcctcg

SEQ ID NO: 457266 - DNA, 514 bp, Homo sapiens
  misc_feature: HEFZJCU01EGJC4.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggacaatggtcaccgtctcttcagcctccaccaaggcccatcggtcttcccctggcaccctcctccaagagcacctctggggcacagcggtcccg

SEQ ID NO: 457267 - DNA, 494 bp, Homo sapiens
  misc_feature: HEFZJCU01BD3BP.40.81.H04.1.454.heavy.3.raw
tctagcgactcacgaccggtgctcgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggcatgtattactgtggaagagacgttggtggctaccgcggggctgaccactc

SEQ ID NO: 457268 - DNA, 528 bp, Homo sapiens; identical to SEQ ID NO: 447197
  misc_feature: HEFZJCU01BQ6VQ.17.34.D01.1.454.heavy.3.raw

SEQ ID NO: 457269 - DNA, 496 bp, Homo sapiens
  misc_feature: HEFZJCU01C7EJJ.13.67.G01.1.454.heavy.3.raw
tcacgtactacacgaccggtgctcgatttagagtatacatattgggtctgggggaggcttggtacagcctggaaggtccctgagactctcctgtgcagcctctggattcacctttagcagctatgccatgacctgggtccgccaggctccagggaaggggctggcgtgggtctcaggtattagtggtagtggtggaagcacatactacgcagactccgtgaagggccggttcaccatctccagagacaattccaagaacacgctgtatctgcaaatgaacagcctgagagccgaggacacggccgtatattactgtgcagcagtggctggcacaggagcatattactttgactactggggccagggaaccctggtcaccgtctcctcagcctccaccaagggcccatcggtcttcccctggcaccctcctccaagagcacctctgggggcacagcggccctgggctgcctggtcaaggactacttctagtacgtga

SEQ ID NO: 457270 - DNA, 517 bp, Homo sapiens; identical to SEQ ID NO: 451963
  misc_feature: HEFZJCU01EFC57.26.71.G05.1.454.heavy.3.raw

SEQ ID NO: 457271 - DNA, 400 bp, Homo sapiens; identical to SEQ ID NO: 444452
  misc_feature: HEFZJCU01CI96C.47.24.C02.1.454.heavy.3.raw

SEQ ID NO: 457272 - DNA, 398 bp, Homo sapiens
  misc_feature: HEFZJCU01EFMHR.4.60.F05.1.454.heavy.3.raw
agcactgtagcacgaccggtgctcgatttagtacgtcatcagggaaaggggctggagtgggtctccactattagtggtagtggtggtagtacatcctatgcagactccgtgaagggccggttcaccatctccagagacaatgccaagaacacggtgtatgtgcaagtgaccagcctgagagtcgaggacacggccgtgtattactgtgcgaaggcctttgccccaaacgtggatatagtggctaactttgactactggggccagggaaccctgggtcaccgtctcctcagcctccaccaagggcccatcggtcttcccctggcgccctgctccaggagcacctccgagagcacagccggcctgggctgcctggtcaaggactacttccctacagtgct

SEQ ID NO: 457273 - DNA, 515 bp, Homo sapiens; identical to SEQ ID NO: 455696
  misc_feature: HEFZJCU01DZUSD.19.2.A02.1.454.heavy.3.raw

SEQ ID NO: 457274 - DNA, 540 bp, Homo sapiens
  misc_feature: HEFZJCU01DRWZB.18.78.H01.1.454.heavy.3.raw
tacgagtatgcacgaccggtgctcgatttagtgtgagtagtttgggtttggggctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaacgcgtacaactactactactacggtatggactctcggggcaaac

SEQ ID NO: 457275 - DNA, 485 bp, Homo sapiens
  misc_feature: HEFZJCU01DDMAE.48.38.D05.1.454.heavy.3.raw
agtatacatacacgaccggtgctcgatttagtatctgatagttgggtttgggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagat

SEQ ID NO: 457276 - DNA, 477 bp, Homo sapiens; identical to SEQ ID NO: 444659
  misc_feature: HEFZJCU01DIPDP.16.10.A10.1.454.heavy.3.raw

SEQ ID NO: 457277 - DNA, 468 bp, Homo sapiens; identical to SEQ ID NO: 448722
  misc_feature: HEFZJCU01CNEKE.4.10.A10.1.454.heavy.3.raw

SEQ ID NO: 457278 - DNA, 525 bp, Homo sapiens
  misc_feature: HEFZJCU01CZ8BO.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggccggggaaccctggtcaccgtctccccaccctccaccaaggcccatcggtcttccccctggcaccctcctccaagagcacctctgggggcacagcggccctgggctgcctggtcaaggactacttcccatactcgta

SEQ ID NO: 457279 - DNA, 517 bp, Homo sapiens; identical to SEQ ID NO: 445699
  misc_feature: HEFZJCU01DO4MY.26.71.G05.1.454.heavy.3.raw

SEQ ID NO: 457280 - DNA, 520 bp, Homo sapiens
  misc_feature: HEFZJCU01D014N.12.40.D07.1.454.heavy.3.raw
atacgacgtacacgaccggtgctcgatttagtgatagagcgtaacaacagagggctcaccatggagtttgggctgagcgtggtttctcgttagctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggcg

SEQ ID NO: 457281 - DNA, 523 bp, Homo sapiens
  misc_feature: HEFZJCU01BVQ0W.47.6.A06.1.454.heavy.3.raw
agctcacgtacacgaccggtgctcgatttagatctactgacagcacacaaggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgattttggtagtggccttgataactggggccaggggatctggtcaccgtctcctcagcctccaccaac

SEQ ID NO: 457282 - DNA, 507 bp, Homo sapiens
  misc_feature: HEFZJCU01ENAMZ.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagaacgtaaagtagacgtggtagttccggggggacgacatgacacc

SEQ ID NO: 457283 - DNA, 520 bp, Homo sapiens
  misc_feature: HEFZJCU01DG6HG.52.74.G08.1.454.heavy.3.raw
cgcagtacgacacgaccggtgctcgatttagtagctctatcaggggatgctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggagtggttattattgggcctggatccggcagcccccgggaaggggctggagtggatcggcagcatccatcatagtggagacaataatcacaatccgtccctcagaggacgagtcaccttttcagtggagacgtccaagaaccaattctccctgaaattgacctctctgaccgccgccgacacggccctttattactgtgcgcgagtgaacacagcaataacttattatgttgaatattggggccagggaaccccggtcaccatctcctcagcctccaccaagggcccatcc

SEQ ID NO: 457284 - DNA, 515 bp, Homo sapiens
  misc_feature: HEFZJCU01BL5E8.51.31.C09.1.454.heavy.3.raw
cgatcgtatacacgaccggtgctcgatttagacgtctcatcaaggaaggaaggggagctctgagagaggagcccagccctgggattttcaggtgttttcatgtggtgatcaggactgaacagagagaactcaccatggagtctgggctgacgtggctttttcttgtggctattttaaaaggtgtccagtgtgacgtgcagctggtggagtctgggggaggcttgatacagccgggggggtccctgagactctcatgtagaacctctggcttcatgtttagagtctatgacatgagttgggtccgccaggctccggggaaggggctggagtgggtctcaatgatcagtgatggtggaacgaccacaaactacgccgactccgtgaagggccggtgcaccatctccagagacaattcgaaggacactttatatctgcaactcaacagactgacacccgcggacacggccgtctactactgtgtgaaagaagacggaccgcgtggacgaggagccaga

SEQ ID NO: 457285 - DNA, 481 bp, Homo sapiens; identical to SEQ ID NO: 448054
  misc_feature: HEFZJCU01BGFV1.22.36.D03.1.454.heavy.3.raw

SEQ ID NO: 457286 - DNA, 501 bp, Homo sapiens; identical to SEQ ID NO: 450306
  misc_feature: HEFZJCU01CEHX7.40.81.H04.1.454.heavy.3.raw

SEQ ID NO: 457287 - DNA, 497 bp, Homo sapiens; identical to SEQ ID NO: 445179
  misc_feature: HEFZJCU01CHDFN.12.55.E11.1.454.heavy.3.raw

SEQ ID NO: 457288 - DNA, 492 bp, Homo sapiens
  misc_feature: HEFZJCU01BB1Q3.48.71.G05.1.454.heavy.3.raw
agtatacatacacgaccggtgctcgatttagtgtcgtcgcaagagagagggggatcacataacaaccacattcctcctctaaagaagtccctgggagcacagctcttcaccatggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcatccctatgtttaagagaatcaggcgtgctgagaagttcgaggacagagtcacctttatggcggacgaatcctcgagcacagtctatatggatctggccagcctgaagtctgaagacacgggcatatatttctgtgcgacagatggtcgtggattctcgtctgcttatgga

SEQ ID NO: 457289 - DNA, 512 bp, Homo sapiens
  misc_feature: HEFZJCU01CF8VR.9.14.B03.1.454.heavy.3.raw
tgatacgtctcacgaccggtgctcgatttagtgtgagtagtttgggtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccacggagcacctccgagagcacagcggcccgtgggctgcctggtcaaggactacttccagtacgtatca

SEQ ID NO: 457290 - DNA, 509 bp, Homo sapiens; identical to SEQ ID NO: 447939
  misc_feature: HEFZJCU01A06AZ.17.25.C03.1.454.heavy.3.raw

SEQ ID NO: 457291 - DNA, 489 bp, Homo sapiens
  misc_feature: HEFZJCU01ESHBM.49.32.C10.1.454.heavy.3.raw
agtcgagagacacgaccggtgctcgatttagtatagacatcaacacacaaaggggtggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatgtcatatgatggaagtaatatatactatatagactccgtgaagggccgattcatcatctccagagacaattccgagaacacgctgtatctgcaaatgaacagcctgagagttgaggacacggctgtgtattattgtgcgaacttaatcac

SEQ ID NO: 457292 - DNA, 525 bp, Homo sapiens
  misc_feature: HEFZJCU01BIYZ8.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttccccctggcaccctcctccacgagcgacctcctcgggggcacgagcggcctcgggcctggcctc

SEQ ID NO: 457293 - DNA, 543 bp, Homo sapiens
  misc_feature: HEFZJCU01ERB7Z.12.85.H08.1.454.heavy.3.raw
  modified_base (148)..(148): a, c, t, g, unknown or other
  modified_base (150)..(150): a, c, t, g, unknown or other
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagcggngngtttctaggtggcttttaaagtagccagtgtgaggtgcaactgttggagtctgggggaggcttggtacagccgggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaacactgtatctgcaattaaccagcctgagagtcgaggacacggccctttattactgtgcgaaggatcgcccctataatggtggcgtggatcggggagtttggttccgtgggggccaggggaaccctgggtcc

SEQ ID NO: 457294 - DNA, 429 bp, Homo sapiens
  misc_feature: HEFZJCU01BGTGD.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctgggctgaggtgaagaagcctggggcctcagtgaaggtctcctgcaaggcttctggatacaccttcaccgcctactatatgcactgggtgcgactggccctggacaagggcttgagtggatgggatggatcgaccctaacagcggtggcacaaagtatgcacagaagtttcagggcagggtcaccatgaccaggggacacgtccatcagcacgtccatcagcacagccctacatgga

SEQ ID NO: 457295 - DNA, 509 bp, Homo sapiens
  misc_feature: HEFZJCU01C1N0O.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaatttctggggccagggagcccaggtcaccgtctccccagcctccaccaagggcccatcggtcttcccctggcgccctgctcaggagcacctccgacgagcacagcggccctgggcctgcctggtccaaggacgtacttcccactacta

SEQ ID NO: 457296 - DNA, 509 bp, Homo sapiens; identical to SEQ ID NO: 447939
  misc_feature: HEFZJCU01CKYJU.17.25.C03.1.454.heavy.3.raw

SEQ ID NO: 457297 - DNA, 498 bp, Homo sapiens
  misc_feature: HEFZJCU01COTG8.40.81.H04.1.454.heavy.3.raw
tctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggagcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctcgtgacgacacggccatgtattactgtaggaagagacgttggtggctaccggcggggctgaccacg

SEQ ID NO: 457298 - DNA, 499 bp, Homo sapiens
  misc_feature: HEFZJCU01EZNTB.4.57.F02.1.454.heavy.3.raw
agcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctgcgccctgctcagagcacctctggggc

SEQ ID NO: 457299 - DNA, 497 bp, Homo sapiens
  misc_feature: HEFZJCU01C1UVP.51.47.E03.1.454.heavy.3.raw
cgatcgtatacacgaccggtgctcgatttagactcgcgcacagagagaagggggtgactcctgtgccccaccatggacacactttgctccacgctcctgctgctgaccatcccttcatgcgtcttgtcccagatcaccttgaaggagtctggtcctacgctggtgaagcccacacagaccctcacgctgacctgcaccttctctgggttctcactctccagtcctgagtggctgtgggctggatccgtcagcccccaggaaaggccctggagtggctggcactcatttattggaatgacgataagacctacagcccatttctgaagaacaggctcaccatcaccaaggacacctccaagaaccaggtgctccttagactgaccaacatggaccctgtggacacagccacatattactgtgtacacgtccccccgccgtacttattatgatgctagtggttattccaacgctgaatacttccagcactggggccaggg

SEQ ID NO: 457300 - DNA, 511 bp, Homo sapiens; identical to SEQ ID NO: 445840
  misc_feature: HEFZJCU01EI8PQ.11.13.B02.1.454.heavy.3.raw

SEQ ID NO: 457301 - DNA, 494 bp, Homo sapiens
  misc_feature: HEFZJCU01AZM45.52.55.E11.1.454.heavy.3.raw
cgcagtacgacacgaccggtgctcgatttagcactcgcacgttgggtttgggggaggcttggtccagcctggtggttccctgagactctcctgtgcagcctctggatttccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttccccctggcaccctcctccaagagcacctctgggggcacagcggccctgggctgcctggtcaaggactacttcctatacgatcg

SEQ ID NO: 457302 - DNA, 525 bp, Homo sapiens
  misc_feature: HEFZJCU01DG47W.16.27.C05.1.454.heavy.3.raw
  modified_base (518)..(518): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttatactgtgcgcggtggctgaccgctcttgactacgtgggggccgggagccccggtnatcgtct

SEQ ID NO: 457303 - DNA, 546 bp, Homo sapiens
  misc_feature: HEFZJCU01BD5F0.52.28.C06.1.454.heavy.3.raw
cgcagtacgacacgaccggtgctcgatttagagctcacgtattgggtttgggagatcatgagggtgtccctgagactctcctgtgcagcctctggattcagctttgatgagtatgccatgcactgggtccggcaggctccagggaagggcctggagtgggtctcaggtattagttggactagtggtagtataggctatggggcctctgtgaagggccgattcaccatctccagagacaacgccaagaactccctgtctctgcaaatgaacggactgagagttgaggacacgggcttctactattgtgcaaaaggccctgcccttttctatgatatcactgcttattactacacgccggttgactcctggggccagggaaccctggtcaccgtctcctcagcctccaccaagggcccatcggtcttcccccgtggccaccctcctaccaagacgctacctcggtcggggcacgacggccggtcccgtcgggctcgccgtcggtacgaacggtaccttaccgtttaccttaacgtacgtactccgcgt

SEQ ID NO: 457304 - DNA, 512 bp, Homo sapiens
  misc_feature: HEFZJCU01AUFJY.12.55.E11.1.454.heavy.3.raw
atacgacgtacacgaccggtgctcgatttagcactcgcacgttgggtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccagagcacctcg

SEQ ID NO: 457305 - DNA, 517 bp, Homo sapiens; identical to SEQ ID NO: 446891
  misc_feature: HEFZJCU01CAFBH.17.33.C11.1.454.heavy.3.raw

SEQ ID NO: 457306 - DNA, 501 bp, Homo sapiens
  misc_feature: HEFZJCU01EYCGB.19.86.H09.1.454.heavy.3.raw
tactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggcgccctgctccaggagcacctccgagagcacagcggccctgggctgcctggtcaaggactacttcccaccgagagta

SEQ ID NO: 457307 - DNA, 524 bp, Homo sapiens
  misc_feature: HEFZJCU01BGPSH.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctcccagagacaattacaagaacaccctttatctgcaaatagacagcctgagaccagacgacacggctgtctattattgcgcgagagagacacacgaacctactggccaatactatgggggcttgttctggggccaggggaccctgggtcatcgtctccccagcctccaccaagggcccatcggtcttccccctggcg

SEQ ID NO: 457308 - DNA, 400 bp, Homo sapiens
  misc_feature: HEFZJCU01CCXL9.16.72.G06.1.454.heavy.3.raw
tgtactactccacgaccggtgctcgatttagctacgactgcaagggaaaggggctggagtgggtctcatctattagtagtagtgatagtgccacatactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttccccctggcaccctcctccaagagcacctctgggggcacagcggccctgggctgcctggtcaaggactacttccgagtagtaca

SEQ ID NO: 457309 - DNA, 522 bp, Homo sapiens
  misc_feature: HEFZJCU01C66FH.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccgaggctccgagggaagggctggagtgcgtctcttttatttatagtagtggtagtacatactccgcagactccgtggacgggccgattccaccatctccagagacaattccaagaacacgctgtttcttcaaatgaacagcctgagagccgatgacacggccgtgtattactgtgcgagagagtgggcccacgaacgttacacgctatggacgtcgtggggccaagggaccg

SEQ ID NO: 457310 - DNA, 515 bp, Homo sapiens; identical to SEQ ID NO: 445422
  misc_feature: HEFZJCU01BVHVU.4.57.F02.1.454.heavy.3.raw

SEQ ID NO: 457311 - DNA, 496 bp, Homo sapiens
  misc_feature: HEFZJCU01CK9BY.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcatggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaaccagcctgagagccgaggacacgggttgtttatactgtgggagaaatcctagtgga

SEQ ID NO: 457312 - DNA, 502 bp, Homo sapiens; identical to SEQ ID NO: 445414
  misc_feature: HEFZJCU01CFS5B.17.25.C03.1.454.heavy.3.raw

SEQ ID NO: 457313 - DNA, 508 bp, Homo sapiens
  misc_feature: HEFZJCU01CNJJO.51.40.D07.1.454.heavy.3.raw
  modified_base (442)..(442): a, c, t, g, unknown or other
cgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggaggcgtggtccagcctgggaggtccctgagactctcctgtgtagtctctggattcaccttcagggtgtacgacatgcactgggtccgccaggctccaggcaaggggctggagtgggtggcatttatatcacatgatggaagtaaaacatactatgcagagtccgtgaagggccgattcaccatctccagagacaattccaagaacacactgtttctgcacatgaaaancctgagagctgaggacacggctgtttattactgtgcgaacttatcacggagacaacggtacccccg

SEQ ID NO: 457314 - DNA, 500 bp, Homo sapiens; identical to SEQ ID NO: 446033
  misc_feature: HEFZJCU01DXA0L.11.27.C05.1.454.heavy.3.raw

SEQ ID NO: 457315 - DNA, 512 bp, Homo sapiens; identical to SEQ ID NO: 450914
  misc_feature: HEFZJCU01BQHHQ.15.67.G01.1.454.heavy.3.raw

SEQ ID NO: 457316 - DNA, 512 bp, Homo sapiens
  misc_feature: HEFZJCU01EDXZ9.11.67.G01.1.454.heavy.3.raw
cgagagataccacgaccggtgctcgatttagagtatacatattggggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggtcttccccctggcaccctcctccaagagcacctctgggggcacagcggcctgggctgcctggtcaaggactaccg

SEQ ID NO: 457317 - DNA, 489 bp, Homo sapiens
  misc_feature: HEFZJCU01D9AVJ.51.76.G10.1.454.heavy.3.raw
cgatcgtatacacgaccggtgctcgatttagtcactcatacagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcccgggaggtccctgagactctcctgtgcagcctctggattcaccttcagtgcctatggcatgcactgggtccgccaggctccaggcaaggggctggagtgggtggcatttatatcagatgatggcagtaataaagagtatgcagtctccgtgaagggccgattcaccatctccagagacaattcccagaacacaactgtatctgcaaatgaacagaattgagtagctgaggacacggctgtgtatttctgtgcgaaacgctatgagtgggtaa

SEQ ID NO: 457318 - DNA, 519 bp, Homo sapiens; identical to SEQ ID NO: 446650
  misc_feature: HEFZJCU01C9LOG.13.76.G10.1.454.heavy.3.raw

SEQ ID NO: 457319 - DNA, 427 bp, Homo sapiens; identical to SEQ ID NO: 444708
  misc_feature: HEFZJCU01D08S4.9.34.D01.1.454.heavy.3.raw

SEQ ID NO: 457320 - DNA, 496 bp, Homo sapiens
  misc_feature: HEFZJCU01D8OZS.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactggtgggagagagtgggaggtcgatattgta

SEQ ID NO: 457321 - DNA, 518 bp, Homo sapiens; identical to SEQ ID NO: 445220
  misc_feature: HEFZJCU01D0D9I.9.70.G04.1.454.heavy.3.raw

SEQ ID NO: 457322 - DNA, 503 bp, Homo sapiens
  misc_feature: HEFZJCU01CUBDR.49.80.H03.1.454.heavy.3.raw
agtcgagagacacgaccggtgctcgatttagctgtgcgtcgaaggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggccaccctcctccaagagcacctctgggggcacagcggccctgggctgcctggtcaaggactactcctctc

SEQ ID NO: 457323 - DNA, 517 bp, Homo sapiens
  misc_feature: HEFZJCU01CN6XS.10.83.H06.1.454.heavy.3.raw
catagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagttggtggagtctgggggaggcttggttcagccagggcggtccctgagactctcttgtacagcctctggatttaggtttcgtgattatgctatgagctggttccggcaggctccagggaaggggctggagtgggtaggtttcattagaagcatagcctatggtggggcttcagaatccgccgcgtctgtgaaaggccgattcaccatctcaagagacgatcccaaaagcctcgcctacctggaaatggacagcctgaaaagcgacgacacaggcgtctattattgtgttagagggaccatcgcgatagcagttcctagagggg

SEQ ID NO: 457324 - DNA, 507 bp, Homo sapiens
  misc_feature: HEFZJCU01B6PZG.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccggggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggccctgggctgcctggtcaaggactacttcctatgtatact

SEQ ID NO: 457325 - DNA, 484 bp, Homo sapiens; identical to SEQ ID NO: 445876
  misc_feature: HEFZJCU01CXM8K.8.39.D06.1.454.heavy.3.raw

SEQ ID NO: 457326 - DNA, 504 bp, Homo sapiens; identical to SEQ ID NO: 447493
  misc_feature: HEFZJCU01A3JUG.48.23.C01.1.454.heavy.3.raw

SEQ ID NO: 457327 - DNA, 396 bp, Homo sapiens; identical to SEQ ID NO: 445898
  misc_feature: HEFZJCU01EW5LG.10.42.D09.1.454.heavy.3.raw

SEQ ID NO: 457328 - DNA, 499 bp, Homo sapiens
  misc_feature: HEFZJCU01EZILR.21.35.D02.1.454.heavy.3.raw
tcgtcgctcgcacgaccggtgctcgatttagcacacgatagttgggtttggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctgaaagaagaggacacggctgtatataactgtgcgcgaggaccttattattatggttcagggaccattgactactggggccagggaaccctggtcaccgtctcctcagcctccaccaagggcccatcggtcttcccctggcgccctgctccaggagcacctccgagagcacagcggccctgggctgcctggtcaaggactacttcccgagcgacga

SEQ ID NO: 457329 - DNA, 500 bp, Homo sapiens; identical to SEQ ID NO: 446033
  misc_feature: HEFZJCU01DEFO8.11.27.C05.1.454.heavy.3.raw

SEQ ID NO: 457330 - DNA, 531 bp, Homo sapiens
  misc_feature: HEFZJCU01BPNNT.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatgggttggggggtagttggggtttttttttcgtacgttacggg

SEQ ID NO: 457331 - DNA, 519 bp, Homo sapiens; identical to SEQ ID NO: 446650
  misc_feature: HEFZJCU01A3F2O.13.76.G10.1.454.heavy.3.raw

SEQ ID NO: 457332 - DNA, 509 bp, Homo sapiens; identical to SEQ ID NO: 454842
  misc_feature: HEFZJCU01DQJQH.2.33.C11.1.454.heavy.3.raw

SEQ ID NO: 457333 - DNA, 545 bp, Homo sapiens
  misc_feature: HEFZJCU01CYYU3.15.86.H09.1.454.heavy.3.raw
tctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaatagactacggtgcacccgtgaaaggaagattcaccatctcaagagataattcaaaacgacggtgtatttgcaatgaacagcctgaaaaccgaggacacagccgtctattactgtaccacagattcggaagtgcatcgacgtaaaggaggctatgcttttgatatctggggtcccaggggacaagt

SEQ ID NO: 457334 - DNA, 518 bp, Homo sapiens
  misc_feature: HEFZJCU01AC7ZF.21.86.H09.1.454.heavy.3.raw
tcgtcgctcgcacgaccggtgctcgatttagtgctatagacttgggtttggggggaagaggaagactgacggtcctgcccgtactgggcctcccatggggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctccctgcatttgcactctgtgactcccgacgacacggctgtctactattgtgtaagacatcccacagggggctccgacactcgacccctggggccagggaaccctagtcaccgtctcctcagcctccaccaagggcccatcggtcttccccctggccgccct

SEQ ID NO: 457335 - DNA, 418 bp, Homo sapiens; identical to SEQ ID NO: 446028
  misc_feature: HEFZJCU01AYWHI.16.28.C06.1.454.heavy.3.raw

SEQ ID NO: 457336 - DNA, 505 bp, Homo sapiens
  misc_feature: HEFZJCU01EPABT.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactgggccagggaaccctggtcaccgtctcttcagcctccaccaaggcccatcggtcttcccctggccaccctcctccaagagcacctctgggggcacagcggccctgggctgcctggtcaaggactacttccgtactagacg

SEQ ID NO: 457337 - DNA, 490 bp, Homo sapiens
  misc_feature: HEFZJCU01CEROD.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggctacttccgtatctctcg

SEQ ID NO: 457338 - DNA, 532 bp, Homo sapiens; identical to SEQ ID NO: 456536
  misc_feature: HEFZJCU01CC7JB.18.59.F04.1.454.heavy.3.raw

SEQ ID NO: 457339 - DNA, 472 bp, Homo sapiens; identical to SEQ ID NO: 447846
  misc_feature: HEFZJCU01A5Z8G.22.56.F01.1.454.heavy.3.raw

SEQ ID NO: 457340 - DNA, 510 bp, Homo sapiens
  misc_feature: HEFZJCU01EJ9ZQ.9.14.B03.1.454.heavy.3.raw
tgatacgtctcacgaccggtgctcgatttagtgtgagtagtttgggtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagccggccctgggctgcctggtcaaggactacttccagacgtatca

SEQ ID NO: 457341 - DNA, 456 bp, Homo sapiens; identical to SEQ ID NO: 444898
  misc_feature: HEFZJCU01CWJEH.10.38.D05.1.454.heavy.3.raw

SEQ ID NO: 457342 - DNA, 517 bp, Homo sapiens
  misc_feature: HEFZJCU01AEYOV.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctgggtccagcctggggggtccctgagactctcctgttcagcctctggattcacctttagtaggttttggatgagttgggtccgccaggctccagggaaggggctggagtgggtggccaacatagagtacgatggaagtgagaaaaactatgtggactccgtgaagggccgattcaccatctccagagacaacgacaagaatttagtgtatctgcaaatgagcagcctgagagccgaggacacggctgtgtattattgtg

SEQ ID NO: 457343 - DNA, 563 bp, Homo sapiens
  misc_feature: HEFZJCU01DE8JY.15.86.H09.1.454.heavy.3.raw
tctacgtagccacgaccggtgctcgatttagtgctatagacttgggtttggggggaagaggaagactgacggtccccccaggagttcgggctgagcgtgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggcgtttcaaaagtaaaatgatggtgagaaaatagactacggtgcacccgtgaaaggaagattcaccatctcaagagataattcaaaaacgacggtgtatttgcaaatgaacagcctgaaaaccgaggacacagccgtctattactgtaccacagattcggaagtgcatcgacgtaaaggaggctatgcttttgatatctggggcccagggacaatggtcgtcgtctcttcagcctccaccaagggcccatcggtcttcccctggcaccctcctcctaagacg

SEQ ID NO: 457344 - DNA, 519 bp, Homo sapiens
  misc_feature: HEFZJCU01C43IS.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtgggccgggggaaccctggtcaccgtctcttcagcctccaccaagggcccatcggtcttcccctggcaccctcctccaagagcacctctcggggcacagcc

SEQ ID NO: 457345 - DNA, 519 bp, Homo sapiens
  misc_feature: HEFZJCU01CG7TI.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccataatcagttgacacgtctaagaaccagttctccctgaagctgagctctgtgactgccgcggacacggccgtgtattactgtgcgaggtcgattgtgatggtaacaactgcttcttactcctttgaccagtgggccggggaacctggtcaccgtctcttcagcctccaccaagggcccatcggtcttcccctgcaccctcctccaagagcacctctcgggggcacgagcc

SEQ ID NO: 457346 - DNA, 518 bp, Homo sapiens
  misc_feature: HEFZJCU01DSGQR.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgaccctggggccagggaacccaggtcaccgtctcctcagcctccaccaagggcccatccgtcttcccctggcgccctgctccaggagcacctccgagagcacagcggccctggctgcctggtcaggactactcctaccg

SEQ ID NO: 457347 - DNA, 390 bp, Homo sapiens; identical to SEQ ID NO: 444541
  misc_feature: HEFZJCU01CWYA2.16.24.C02.1.454.heavy.3.raw

SEQ ID NO: 457348 - DNA, 507 bp, Homo sapiens
  misc_feature: HEFZJCU01CHGGQ.51.12.B01.1.454.heavy.3.raw
cgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttgacgacacggccgtctattactgtgcgacagaagcggcggacagaggttcgcttactggttcgaggctctcccc

SEQ ID NO: 457349 - DNA, 509 bp, Homo sapiens
  misc_feature: HEFZJCU01EDJ5C.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactgggggcccggagccctggt

SEQ ID NO: 457350 - DNA, 520 bp, Homo sapiens
  misc_feature: HEFZJCU01CTVTK.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtatttggacctgaacagcctaagtcctgaggacacgggtgtatactactgtacggaagggaggggggaaccgaggcgggagttccaagtactcctttg

SEQ ID NO: 457351 - DNA, 520 bp, Homo sapiens
  misc_feature: HEFZJCU01C1AR8.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctcggcaccctcctccaagagcacctctgggggcacagcggccctgggctgcctggtcaaggactacttcctagagacacg

SEQ ID NO: 457352 - DNA, 399 bp, Homo sapiens; identical to SEQ ID NO: 448741
  misc_feature: HEFZJCU01A2Q6C.47.24.C02.1.454.heavy.3.raw

SEQ ID NO: 457353 - DNA, 379 bp, Homo sapiens; identical to SEQ ID NO: 444450
  misc_feature: HEFZJCU01AYZ6U.47.77.G11.1.454.heavy.3.raw

SEQ ID NO: 457354 - DNA, 501 bp, Homo sapiens
  misc_feature: HEFZJCU01CULM0.19.26.C04.1.454.heavy.3.raw
tactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccaagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctgggggacacggctgtgtattactgtgcgagagcggctggcaactacatccatttac

SEQ ID NO: 457355 - DNA, 487 bp, Homo sapiens
  misc_feature: HEFZJCU01B88KA.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaaggcccatcggtcttcccctggcgccctgctccagagcacctccgagagcacagcggcctgggctgcctggtcaggactacttccgtatctctcg

SEQ ID NO: 457356 - DNA, 519 bp, Homo sapiens
  misc_feature: HEFZJCU01CU4HB.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctcggcaccctcctccaagagcacctctgggggcacagcggccctgggctgcctggtcaaggactacttccagacgtatca

SEQ ID NO: 457357 - DNA, 511 bp, Homo sapiens; identical to SEQ ID NO: 446799
  misc_feature: HEFZJCU01ENEDA.18.39.D06.1.454.heavy.3.raw

SEQ ID NO: 457358 - DNA, 502 bp, Homo sapiens; identical to SEQ ID NO: 448699
  misc_feature: HEFZJCU01EL577.10.34.D01.1.454.heavy.3.raw

SEQ ID NO: 457359 - DNA, 515 bp, Homo sapiens
  misc_feature: HEFZJCU01BNQN4.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaatgaacagcctaagtcctgaggacacgggtgtatactactgtacgaaggaggggggaaccagcgggagttccaagtactcctttgacgtctgggccac

SEQ ID NO: 457360 - DNA, 511 bp, Homo sapiens
  misc_feature: HEFZJCU01CBGQI.51.40.D07.1.454.heavy.3.raw
cgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggaggcgtggtccagcctgggaggtccctgagactctcctgtgtagtctctggattcaccttcagggtgtacgacatgcactgggtccgccaggctccaggcaaggggctggagtgggtggcatttatatcacatgatggaagtaaaacatactatgcagagtccgtgaagggccgattcaccatctccagagacaattccaagaacacactgtttctgcacatgaaaagcctgagagctgaggacacggctgtttattactgtgcgaacttaatcacggaggacaacggtaacccccg

SEQ ID NO: 457361 - DNA, 509 bp, Homo sapiens
  misc_feature: HEFZJCU01BAATS.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccctggccgccctcgctccaggacg

SEQ ID NO: 457362 - DNA, 509 bp, Homo sapiens; identical to SEQ ID NO: 450245
  misc_feature: HEFZJCU01BKD4E.4.12.B01.1.454.heavy.3.raw

SEQ ID NO: 457363 - DNA, 522 bp, Homo sapiens
  misc_feature: HEFZJCU01EKFK1.53.36.D03.1.454.heavy.3.raw
cgcgtatacacacgaccggtgctcgatttagctgcgtcacgatctctcttgggggaggcttggttcagccagggcggtccctgagactctcctgtacaacttcaggattcacctttggtgattatgctatgacctgggtccgccaggctccagggaaggggctggagtgggtaggtttcgttagaagcaaaactgatggtgggacaacagaatacgccgcgtctgtgaaaggcagatttatcatctcaagagatgattccagaggcatcgcctatctgcaaatgaacagcctgaaaaccgaggacacagccgtgtatttctgtactagagtcttcttgtattactatgatactagtggttatacaggagtggggcacggtatggacgtctggggccaagggaccacggtcaccgtctcctcagcctccaccaagggcccatcggtcttcccctggcaccctcctccaagagcacctctggggcacagcggccctgggctgcctggtcaaggactactcctcg

SEQ ID NO: 457364 - DNA, 520 bp, Homo sapiens
  misc_feature: HEFZJCU01CTHZ2.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctcaccaaggcccatcggtctccctgcgcctgctcaggagcacctccgagagcacagcggccctgggctgcctggtcaaggactacttccacg

SEQ ID NO: 457365 - DNA, 400 bp, Homo sapiens; identical to SEQ ID NO: 444452
  misc_feature: HEFZJCU01C120T.47.24.C02.1.454.heavy.3.raw

SEQ ID NO: 457366 - DNA, 519 bp, Homo sapiens
  misc_feature: HEFZJCU01ERNPJ.49.28.C06.1.454.heavy.3.raw
agtcgagagacacgaccggtgctcgatttagagctcacgtattgggtttggggagctctgggagaggagcccagcactagaagtcggcggtgtttccattcggtgatcagcactgaacacagaggactcaccatggagtttgggctgagcgtggtttcgtcgttaggcgtctttaagaggtgtcctttgttgggtgcagttggtggagtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattcaccatctccagagacaattcgaagaacaccatgtatctggaactgagcagagtcacatctgaggacacggctatgtaattactgtgtgaaagacttttatgacagtagtggtttctccgagtatg

SEQ ID NO: 457367 - DNA, 535 bp, Homo sapiens
  misc_feature: HEFZJCU01CAJQ3.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactgggtacggggagttacttcctccgcaacggtatggacgtctggggccaagggaccacggtcaccgtctccttagcctccaccaagggcccatcggtccttcccctggccaccctcctccaagagcacctctc

SEQ ID NO: 457368 - DNA, 460 bp, Homo sapiens; identical to SEQ ID NO: 444688
  misc_feature: HEFZJCU01AK4CY.53.12.B01.1.454.heavy.3.raw

SEQ ID NO: 457369 - DNA, 393 bp, Homo sapiens; identical to SEQ ID NO: 444509
  misc_feature: HEFZJCU01APT96.49.46.E02.1.454.heavy.3.raw

SEQ ID NO: 457370 - DNA, 513 bp, Homo sapiens
  misc_feature: HEFZJCU01AZF9R.40.38.D05.1.454.heavy.3.raw
tctagcgactcacgaccggtgctcgatttagtatctgatagttgggtttggggatgctttctgagagtcagggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggttggatccgccagcccccagggaaggggctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactgtgtgagacgggtgccccaagaaaagtgttttatcctgggcagggaacctgtcaccgtctcctcagcctccaccaac

SEQ ID NO: 457371 - DNA, 536 bp, Homo sapiens
  misc_feature: HEFZJCU01BSW3S.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctggggcccgggaaccctggtcaccgtctcctcagcctccaccaaggcccatcggtcttccccctggccaccctcctcccagacg

SEQ ID NO: 457372 - DNA, 491 bp, Homo sapiens
  misc_feature: HEFZJCU01BB9BA.18.70.G04.1.454.heavy.3.raw
tacgagtatgcacgaccggtgctcgatttagtgtagtgtgaagggaaagggggaagaggaagactgatggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggccaagggaccacggtcaccggtctcctcagcctccaccaagggcccatcggtcttccccctggcaccctcctccaagagcacctctgggggcacagcggccctgggctgcctggtcaaggactacttcccatactcgta

SEQ ID NO: 457373 - DNA, 499 bp, Homo sapiens
  misc_feature: HEFZJCU01BTV2V.9.53.E09.1.454.heavy.3.raw
tgatacgtctcacgaccggtgctcgatttagagagagtgtgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaaggggacactggtcaccgtctcttcagcctccaccaagggcccatcggtcttccccctggccgccctgct

SEQ ID NO: 457374 - DNA, 482 bp, Homo sapiens; identical to SEQ ID NO: 444503
  misc_feature: HEFZJCU01ELCF2.7.10.A10.1.454.heavy.3.raw

SEQ ID NO: 457375 - DNA, 497 bp, Homo sapiens; identical to SEQ ID NO: 451440
  misc_feature: HEFZJCU01EG4MN.40.81.H04.1.454.heavy.3.raw

SEQ ID NO: 457376 - DNA, 493 bp, Homo sapiens
  misc_feature: HEFZJCU01AI58M.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaatcctagtggc

SEQ ID NO: 457377 - DNA, 392 bp, Homo sapiens; identical to SEQ ID NO: 444456
  misc_feature: HEFZJCU01C7ASU.7.60.F05.1.454.heavy.3.raw

SEQ ID NO: 457378 - DNA, 316 bp, Homo sapiens; identical to SEQ ID NO: 444479
  misc_feature: HEFZJCU01AFJ69.47.84.H07.1.454.heavy.3.raw

SEQ ID NO: 457379 - DNA, 495 bp, Homo sapiens; identical to SEQ ID NO: 446614
  misc_feature: HEFZJCU01CIBBY.13.85.H08.1.454.heavy.3.raw

SEQ ID NO: 457380 - DNA, 449 bp, Homo sapiens
  misc_feature: HEFZJCU01CB3PN.51.73.G07.1.454.heavy.3.raw
cgatcgtatacacgaccggtgctcgatttagctctacgctcagggcacgaccagtgctcgatttagtgagtcagtaagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 457381 - DNA, 537 bp, Homo sapiens
  misc_feature: HEFZJCU01C0ZK2.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaaaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaaggggaccacggtcaccgtctccttagcctccaccaagggcccatcggtcttccccctggcaccctcctccaagagcacctctc

SEQ ID NO: 457382 - DNA, 513 bp, Homo sapiens
  misc_feature: HEFZJCU01CUKGC.8.34.D01.1.454.heavy.3.raw
  modified_base (504)..(504): a, c, t, g, unknown or other
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggaggggggaaccgagcgggagtcaagtacncctttgacg

SEQ ID NO: 457383 - DNA, 498 bp, Homo sapiens
  misc_feature: HEFZJCU01CBOHP.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgttcttgcaaatgaacagcctgagaattgaggactcgggtatatactactgtgcccgtgacccctgactgataaaccggactggttcgaccctggggccagggaaccctggtcaccgtctcct

SEQ ID NO: 457384 - DNA, 514 bp, Homo sapiens
  misc_feature: HEFZJCU01CD5WZ.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctgcgccctcgctccaggagccaccctccgacgagcacagcggccctgggctgcctggtcaaggactactt

SEQ ID NO: 457385 - DNA, 505 bp, Homo sapiens; identical to SEQ ID NO: 445664
  misc_feature: HEFZJCU01ETE6D.12.33.C11.1.454.heavy.3.raw

SEQ ID NO: 457386 - DNA, 500 bp, Homo sapiens; identical to SEQ ID NO: 446033
  misc_feature: HEFZJCU01DQJT7.11.27.C05.1.454.heavy.3.raw

SEQ ID NO: 457387 - DNA, 549 bp, Homo sapiens
  misc_feature: HEFZJCU01EQI73.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagcgtggcttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaacactgtatctgcaattaaccagcctgagagtcgaggacacggccctttattactgtgcgaaggatcgcccctataatggtggttggagtcggggagtttgggttcctggggccgacgggaaccctggtcgtacccg

SEQ ID NO: 457388 - DNA, 526 bp, Homo sapiens
  misc_feature: HEFZJCU01B95E1.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaagggcccatcggtcttccccctggcaccctcctccaagagcacctctgggggcacagcggccctgggctgcctggtcaaggactacttccatactcgta

SEQ ID NO: 457389 - DNA, 404 bp, Homo sapiens
  misc_feature: HEFZJCU01AJE2F.16.72.G06.1.454.heavy.3.raw
tgtactactccacgaccggtgctcgatttagctacgactgcaagggaaaggggctggagtgggtctcatctattagtagtagtgatagtgccacatactacgcagactccgtgaagggccggttcaccatctccagagatagatccaagaacacgctgtatctgcaaatggacagcctgagagccgaggacacggccatatattactgtgcgaaagatctggggaatgactacgatggtaccaacgtccgcttggactcctggggccagggagccctggtcaccgtctcctcagcctccaccaagggcccatcggtcttccccctggcgccctgctccaggagcacctccgagagcacagcggccctgggctgccctggtcaaggactacttccgagtagtaca

SEQ ID NO: 457390 - DNA, 535 bp, Homo sapiens
  misc_feature: HEFZJCU01AOY54.17.28.C06.1.454.heavy.3.raw
  modified_base (339)..(339): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaanataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccagggagccctggtcaccg

SEQ ID NO: 457391 - DNA, 508 bp, Homo sapiens; identical to SEQ ID NO: 454138
  misc_feature: HEFZJCU01A3DAA.18.50.E06.1.454.heavy.3.raw

SEQ ID NO: 457392 - DNA, 477 bp, Homo sapiens
  misc_feature: HEFZJCU01AIDMN.4.87.H10.1.454.heavy.3.raw
agcactgtagcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaggaagcctggggcctcagtgaaggtctcctgcaagacttctggatacaccttcgccggctactatatgcactggattcgacaggcccctggacaagggcttgagtggatggggtggatcaacccttacagtggtgtcacaaactatgcacagaagtttcagggctgggtcaccgtgaccagggacacgtccgtcagcacagtttacatggaactgaggaaactgagatctgacgacacggccgtctactactgtgcgagagggtacacggt

SEQ ID NO: 457393 - DNA, 509 bp, Homo sapiens; identical to SEQ ID NO: 447939
  misc_feature: HEFZJCU01BRKZU.17.25.C03.1.454.heavy.3.raw

SEQ ID NO: 457394 - DNA, 527 bp, Homo sapiens; identical to SEQ ID NO: 446775
  misc_feature: HEFZJCU01CNG5W.9.78.H01.1.454.heavy.3.raw

SEQ ID NO: 457395 - DNA, 513 bp, Homo sapiens; identical to SEQ ID NO: 446452
  misc_feature: HEFZJCU01C9OQM.17.33.C11.1.454.heavy.3.raw

SEQ ID NO: 457396 - DNA, 535 bp, Homo sapiens
  misc_feature: HEFZJCU01B3AJM.48.28.C06.1.454.heavy.3.raw
agtatacatacacgaccggtgctcgatttagagctcacgtattgggtttggggtgggagaggagctccagccttgggactcccagctgtctccactcggtgatcggcactgaatacaggagactcaccatggagtttgggctgagctgggttttccttgttgctattttaaaaggtgtccagtgtgaggtgcagttggtgcagtccgggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattgggg

SEQ ID NO: 457397 - DNA, 532 bp, Homo sapiens
  misc_feature: HEFZJCU01DG1A7.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgaccctggggcccggaacctggtcaccgtctcctcacgcctccaccaagggcccatcggtcttcccctc

SEQ ID NO: 457398 - DNA, 500 bp, Homo sapiens
  misc_feature: HEFZJCU01BQIY2.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactctagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtgacccctgactgataaaccggactggttcgaccctcggggccagggaaccctggtcaccgtctcctc

SEQ ID NO: 457399 - DNA, 508 bp, Homo sapiens
  misc_feature: HEFZJCU01EQDVN.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaaggggctgggagtggctcgcacttatttacagtggcggcactacatactacacagacttcgcgaggggccgattcaccatctccagagacgattccaagaacacgttgtatcttcaatgaacagcctgacagtcgacgacacggccatgtatttttgtgcgagcgacccggggctcctcaatggctttcattacg

SEQ ID NO: 457400 - DNA, 409 bp, Homo sapiens; identical to SEQ ID NO: 444519
  misc_feature: HEFZJCU01EPQT2.3.41.D08.1.454.heavy.3.raw

SEQ ID NO: 457401 - DNA, 483 bp, Homo sapiens
  misc_feature: HEFZJCU01BTSSQ.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctcgcagctgacctctgtgactcccgaggacacgggtgtatattactgtggaagaggccccatacg

SEQ ID NO: 457402 - DNA, 477 bp, Homo sapiens; identical to SEQ ID NO: 444659
  misc_feature: HEFZJCU01DIGD9.16.10.A10.1.454.heavy.3.raw

SEQ ID NO: 457403 - DNA, 476 bp, Homo sapiens
  misc_feature: HEFZJCU01CLHLI.48.56.F01.1.454.heavy.3.raw
agtatacatacacgaccggtgctcgatttagcagacgtctgaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtggtggcacacgctattcacagaagtttcagggcagggtcaccatgaccagggacacgtccatcagcacagcctacatggaattgagcaggctgacatctgacgacacggccgtgtattattgtgcgagagcctcacg

SEQ ID NO: 457404 - DNA, 477 bp, Homo sapiens; identical to SEQ ID NO: 444659
  misc_feature: HEFZJCU01B2CFD.16.10.A10.1.454.heavy.3.raw

SEQ ID NO: 457405 - DNA, 520 bp, Homo sapiens
  misc_feature: HEFZJCU01D88GJ.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagccaagacagattttggagttggttacttggttggactactttgactacgtgggggccaggggaacccctgggtcc

SEQ ID NO: 457406 - DNA, 502 bp, Homo sapiens
  misc_feature: HEFZJCU01ESVNV.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgacaaagatccaaccccttacgtt

SEQ ID NO: 457407 - DNA, 531 bp, Homo sapiens
  misc_feature: HEFZJCU01D9KA7.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgtacttctggggccatcggaaccccggtccg

SEQ ID NO: 457408 - DNA, 516 bp, Homo sapiens; identical to SEQ ID NO: 447339
  misc_feature: HEFZJCU01AM8QM.46.67.G01.1.454.heavy.3.raw

SEQ ID NO: 457409 - DNA, 378 bp, Homo sapiens
  misc_feature: HEFZJCU01DZTOE.47.77.G11.1.454.heavy.3.raw
agctcacgtacacgaccggtgctcgatttagctagtcactcaagggaaagggctggagtgggtctcaggcattggtggtagtggtgccaggacacattatgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 457410 - DNA, 511 bp, Homo sapiens
  misc_feature: HEFZJCU01D6VEH.52.26.C04.1.454.heavy.3.raw
cgcagtacgacacgaccggtgctcgatttagtctagcgactttgggtttggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctggcaccctcctccaagagcacctctgggggcacagcggccctgggctgcctggtcaaggactacttcctatacg

SEQ ID NO: 457411 - DNA, 501 bp, Homo sapiens; identical to SEQ ID NO: 447719
  misc_feature: HEFZJCU01CKEGG.17.10.A10.1.454.heavy.3.raw

SEQ ID NO: 457412 - DNA, 406 bp, Homo sapiens
  misc_feature: HEFZJCU01CQWNC.52.33.C11.1.454.heavy.3.raw
cgcagtacgacacgaccggtgctcgatttagagtgagctcgttgggttggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaaggtttgagtggatgggatggatcaccgctggcaatggtgacacaaaatattcacagaagttccagggcagagtcaccattaacagggacacatctgcgagtacaggctacatggaa

SEQ ID NO: 457413 - DNA, 506 bp, Homo sapiens
  misc_feature: HEFZJCU01CR66M.48.27.C05.1.454.heavy.3.raw
agtatacatacacgaccggtgctcgatttagacgcgatcgaagggtttgggggattcccaggtgtttccattcagtgatcagcactgaacacagaggactcaccatggagttgggactgagctggattttcctttggctattttaaaagctgtccagtgtgaagtgcacctggtggagtctgggggaggcttggtacagcctggcaggtccctgagactctcctgtgcagcctctggattcacctttgatgattatgccatgcactgggtccggcaagttccagggaaggcctggagtgggtctcaggcattagtagaattaggggtagcatagcctatgcggattctgtgaagggccgattcaccatctccagagacaacgccaagaacctccctgtatctgcaaatgaacagtctgagacctgaggacacggccttctattactgtgacaaagatcaggcattagactacaacggtatggacgtcgtggggccaaggggatcac

SEQ ID NO: 457414 - DNA, 522 bp, Homo sapiens
  misc_feature: HEFZJCU01CGJL5.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgcctgctccaggagcacctccg

SEQ ID NO: 457415 - DNA, 503 bp, Homo sapiens; identical to SEQ ID NO: 445995
  misc_feature: HEFZJCU01ACXF6.17.25.C03.1.454.heavy.3.raw

SEQ ID NO: 457416 - DNA, 510 bp, Homo sapiens
  misc_feature: HEFZJCU01CIZ90.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaaggcccatcggtccttcccctggc

SEQ ID NO: 457417 - DNA, 476 bp, Homo sapiens; identical to SEQ ID NO: 444967
  misc_feature: HEFZJCU01AW7M9.16.10.A10.1.454.heavy.3.raw

SEQ ID NO: 457418 - DNA, 447 bp, Homo sapiens
  misc_feature: HEFZJCU01A3QNQ.53.57.F02.1.454.heavy.3.raw
cgcgtatacacacgaccggtgctcgatttagctcgatatagttgggtttgggctcggggctgccctttggctttggagatggttttctcgatgggggctggagtgggtggcagttatatcaaatgatggaagtaagaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctgggccaagggaccacggtcaccgtctcctcagcctccaccaagggcccatcggtcttccccctggcaccctcctccaagagcacctctggggcacagcggccctgggctgcctggtcaaggactacttcctcgtactgcg

SEQ ID NO: 457419 - DNA, 547 bp, Homo sapiens
  misc_feature: HEFZJCU01DG50Z.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaaacgtccgaagtcgttatcactttgactcctgggccagggaaccctggtcagcgtctcttcagcctccaccaagggcccatcggtcttccccctcggccaccctccctcccaacgacgcacctctgggggcacgagcggccctgggcctgcctc

SEQ ID NO: 457420 - DNA, 465 bp, Homo sapiens; identical to SEQ ID NO: 444805
  misc_feature: HEFZJCU01CH4G3.19.10.A10.1.454.heavy.3.raw

SEQ ID NO: 457421 - DNA, 477 bp, Homo sapiens
  misc_feature: HEFZJCU01DB3NU.12.81.H04.1.454.heavy.3.raw
atacgacgtacacgaccggtgctcgatttagtagtgtagattcgcgggggggtccctgagactctcttgtgcaggctctggactcagcattagcaattatgccgtgagctgggtccgccaggttgcaggaaagggtctggaatgggtctcagtaattagtcatagtggtgatgtcacactctacgcggactccgtgaagggccggttcaccatctccagagacaattccaagaacacagtgtatttgcaaatgaacagcctgaaagccgatgacacggccatatattattgtgtgagagatgacgaaagcgaatatccattcgatcttgactactggggccagggaacccttgtcaccgtctcctcagcctccaccaagggcccatcggtcttcccctggcgccctgctccaggagcacctccgagagcacagcggcccgtgggctgcctggtcaaggactacttcctacgtcgtat

SEQ ID NO: 457422 - DNA, 514 bp, Homo sapiens; identical to SEQ ID NO: 445776
  misc_feature: HEFZJCU01ELPI4.17.33.C11.1.454.heavy.3.raw

SEQ ID NO: 457423 - DNA, 507 bp, Homo sapiens
  misc_feature: HEFZJCU01AE4JY.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggccgccctgctccaggagcacctccgagagcacagccggccctgggctgcctggtcaaggactacttcccactacta

SEQ ID NO: 457424 - DNA, 518 bp, Homo sapiens
  misc_feature: HEFZJCU01ES5SL.10.87.H10.1.454.heavy.3.raw
catagtagtgcacgaccggtgctcgatttagcagtactgcgttgggtttgggggggagaggagcccagcactagaagtcggcggtgtttccattcggtgatcagcagtgaacacaaaggactcaccatggagtttgggctgagctgggttttcctggtggctcttttaggaggtgcccagtgtcaagtgcagctggtggagtctgggggaggcgtggtccagcctggggggtccctgagactctcctgtgcagcctctggattcgacttcgaaatgtctggcatgcactgggtccgccaggctccaacgaaggggctggagtgggtggcagttctttcatttgatgaaaaaagggaatattatgcgacctccgtgaagggccgattcagcatctccagagacatttccaaggccacggtgtatctgcaaatgaccagcctgagaagtgaggacacggctatgtactattgtgcggaaggaccttccacctgaaactaatatgggggctttgaacactc

SEQ ID NO: 457425 - DNA, 378 bp, Homo sapiens; identical to SEQ ID NO: 444463
  misc_feature: HEFZJCU01CKK7L.47.77.G11.1.454.heavy.3.raw

SEQ ID NO: 457426 - DNA, 503 bp, Homo sapiens
  misc_feature: HEFZJCU01CIVRF.17.10.A10.1.454.heavy.3.raw
  modified_base (462)..(462): a, c, t, g, unknown or other
cgtagactagcacgaccggtgctcgatttagcgtcgatctcaggggacccgaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattacctgtgcgagaatgttttcngtcatcgtacaatttgataggctctatggactggacttctc

SEQ ID NO: 457427 - DNA, 500 bp, Homo sapiens; identical to SEQ ID NO: 450218
  misc_feature: HEFZJCU01ECIB4.17.10.A10.1.454.heavy.3.raw

SEQ ID NO: 457428 - DNA, 499 bp, Homo sapiens
  misc_feature: HEFZJCU01DIPHE.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaatctccctgaagctgagctctgtgaccgccgcagacacggctgtctattactgtgcgaggccccgagcgcagtggctttttgatgcctttgatatgtggggccaagggacaatggt

SEQ ID NO: 457429 - DNA, 489 bp, Homo sapiens
  misc_feature: HEFZJCU01C8LW8.16.37.D04.1.454.heavy.3.raw
  modified_base (380)..(380): a, c, t, g, unknown or other
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcgtgactgctattgactactgggccagggaacccctggtcaccgtntcctcagctccaccaaggcccatcggtctcccctggcacctcctccagagcacctctgggggcacagcggccctggctgcctggtcaaggactacttccgagtagtaca

SEQ ID NO: 457430 - DNA, 525 bp, Homo sapiens
  misc_feature: HEFZJCU01CKQTS.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgccctgctccaggagcacctccgagagcacagcggccctgggg

SEQ ID NO: 457431 - DNA, 531 bp, Homo sapiens
  misc_feature: HEFZJCU01EIC9H.40.20.B09.1.454.heavy.3.raw
tctagcgactcacgaccggtgctcgatttagtgtagtgtgaagggggagccttagccctggattccaaggcctatccacttggtgatcagcactgagcaccgaggagtcaccatggaactgggactccgctgggttttccttgttgcgattttagaaggtgtcaagtgtgaggtgcgactggtcgagtctgggggaggcctggtcaagccgggggggtccctgagactctcctgtgcagcctctggactcaccttcaggagtttcagtatgaattgggtccgccaggctccagggaaggggctggagtgggtctcatccatcagcagtggtagcacttacatacactatgcagactcagtgaagggccgattcaccatctccagagacaacgccgggaactccctgtatctgcaaatgaagagcctgcgagccgaggacacgggtgtttattattgtactaaaggacaagagggactttggggagtactactacggtatggacgtctggggccaagggaccgccgtcaccg

SEQ ID NO: 457432 - DNA, 529 bp, Homo sapiens
  misc_feature: HEFZJCU01DYIM2.9.33.C11.1.454.heavy.3.raw
  modified_base (466)..(466): a, c, t, g, unknown or other
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacgagtggcagctccaagtactactttgacttctgggccagggaaccctggtcaccgtctcctcngcctccaccaagggcccatcggtcttcccctcggcgccctgctccaggagcacctccgagacg

SEQ ID NO: 457433 - DNA, 429 bp, Homo sapiens; identical to SEQ ID NO: 447944
  misc_feature: HEFZJCU01BYP9E.4.37.D04.1.454.heavy.3.raw

SEQ ID NO: 457434 - DNA, 374 bp, Homo sapiens
  misc_feature: HEFZJCU01DDXZL.49.72.G06.1.454.heavy.3.raw
agtcgagagacacgaccggtgctcgattagctacgactgcaagggaaaggggctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccaccaagggcccatcggtcttcccctggcgccctgctccaggagcacctccgagagcacagcggccctgggctgcctggtcaaggattacttcctctctcgact

SEQ ID NO: 457435 - DNA, 545 bp, Homo sapiens
  misc_feature: HEFZJCU01BTR7Y.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgtatttttggtatgtcgtggggccaaggtacagcggtcaccgtcgcctcacgcctcccaccaacgggcccatccggttccttcccccgtcggcctacccctccctcccaacgacgccaccctcgtcggggggccacgac

SEQ ID NO: 457436 - DNA, 400 bp, Homo sapiens; identical to SEQ ID NO: 444452
  misc_feature: HEFZJCU01D5GCY.47.24.C02.1.454.heavy.3.raw

SEQ ID NO: 457437 - DNA, 506 bp, Homo sapiens; identical to SEQ ID NO: 444674
  misc_feature: HEFZJCU01DXYJB.12.33.C11.1.454.heavy.3.raw

SEQ ID NO: 457438 - DNA, 506 bp, Homo sapiens; identical to SEQ ID NO: 444696
  misc_feature: HEFZJCU01BVD6Z.16.34.D01.1.454.heavy.3.raw

SEQ ID NO: 457439 - DNA, 487 bp, Homo sapiens; identical to SEQ ID NO: 452643
  misc_feature: HEFZJCU01DS85J.4.6.A06.1.454.heavy.3.raw

SEQ ID NO: 457440 - DNA, 499 bp, Homo sapiens; identical to SEQ ID NO: 447792
  misc_feature: HEFZJCU01EDX1A.17.10.A10.1.454.heavy.3.raw

SEQ ID NO: 457441 - DNA, 507 bp, Homo sapiens
  misc_feature: HEFZJCU01D6WAS.4.12.B01.1.454.heavy.3.raw
agcactgtagcacgaccggtgctcgatttagtagtgtagattccacggggctgtgcaagaacatgaaacatctgtggttcttccttctcctggtggcagttcccagatgggtcctgtcccaggtgcagctgcgggagtcgggcccaggactggtgaagccttcggagaccctgtccctcacctgcactgtctctggtggcttcatggatggttactactggagttgggtccggcagtccccaacacagggactgcagtggattggatacatctacttcagtgggaaccccaactacaacccctccctcaggagtccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcagcctccaccaaggcccatcggtcttccccct

SEQ ID NO: 457442 - DNA, 475 bp, Homo sapiens
  misc_feature: HEFZJCU01CWQ68.4.37.D04.1.454.heavy.3.raw
  modified_base (463)..(463): a, c, t, g, unknown or other
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctgacacacgccgtatnttctgtgcgagg

SEQ ID NO: 457443 - DNA, 529 bp, Homo sapiens; identical to SEQ ID NO: 446480
  misc_feature: HEFZJCU01B80Y4.18.33.C11.1.454.heavy.3.raw

SEQ ID NO: 457444 - DNA, 531 bp, Homo sapiens
  misc_feature: HEFZJCU01CQMLN.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccacccctccaaccg

SEQ ID NO: 457445 - DNA, 534 bp, Homo sapiens; identical to SEQ ID NO: 445832
  misc_feature: HEFZJCU01BU3RD.17.28.C06.1.454.heavy.3.raw

SEQ ID NO: 457446 - DNA, 517 bp, Homo sapiens
  misc_feature: HEFZJCU01EUUYW.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggcctgggctgcctgtcaaggactacttccagacgtatca

SEQ ID NO: 457447 - DNA, 511 bp, Homo sapiens
  misc_feature: HEFZJCU01B4R9J.48.34.D01.1.454.heavy.3.raw
agtatacatacacgaccggtgctcgatttagatcgtctgtgttgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccacggaaccctggtcaccgtctcctcagcctccaccaagggcccatcggtcttcccctggcgccctgctccaggagcacctccgagagcacagcggccctgggctgcctggtcaaggactactt

SEQ ID NO: 457448 - DNA, 489 bp, Homo sapiens
  misc_feature: HEFZJCU01BK35E.11.26.C04.1.454.heavy.3.raw
  modified_base (472)..(472): a, c, t, g, unknown or other
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaggntacttccgtatctctcg

SEQ ID NO: 457449 - DNA, 525 bp, Homo sapiens
  misc_feature: HEFZJCU01AJIPL.9.34.D01.1.454.heavy.3.raw
tgatacgtctcacgaccggtgctcgatttagatcgtctgtgttgggtttgggcatgtgtgagttttgtcacaagatttgggctcaactttcttgtccaccttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggccaccctcctccaagagcacctctgggggcacagcggcccg

SEQ ID NO: 457450 - DNA, 501 bp, Homo sapiens; identical to SEQ ID NO: 449500
  misc_feature: HEFZJCU01B7NHK.17.25.C03.1.454.heavy.3.raw

SEQ ID NO: 457451 - DNA, 402 bp, Homo sapiens
  misc_feature: HEFZJCU01AKL49.11.70.G04.1.454.heavy.3.raw
cgagagataccacgaccggtgctcgatttagtgtagtgtgaagggaaaggggactggagtggattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtcttccccctggcaccctcctccaagagcacctctggggcacagcggccctgggctgcctggtcaaggactacttccgtatctctcg

SEQ ID NO: 457452 - DNA, 492 bp, Homo sapiens; identical to SEQ ID NO: 445919
  misc_feature: HEFZJCU01AQ5OM.14.25.C03.1.454.heavy.3.raw

SEQ ID NO: 457453 - DNA, 536 bp, Homo sapiens
  misc_feature: HEFZJCU01A2ID4.13.6.A06.1.454.heavy.3.raw
tcacgtactacacgaccggtgctcgatttagatctactgacagggtctccgaaggcttcaccagtcctgtcccaggtgcagctgcgggagtcgggcccaggactggtgaagccttcggagaccctgtccctcacctgcactgtctctggtggctccatcagtagttactactggagctggatccggcagcccccagggaagggactggagtggattgggcatatcttttacagttgggagcaccaactacaacccctccctcaagagtcgagtcaccatatcagtggacacgtccaagaaccagttctccctgaagctgagctctgtgaccgctgcggacacggccgtgtattactgtgcgagctggggttcaggggtactttgactactggggccagggaaccctggtcaccgtctcctcagcctccaccagggcccatcggtcttcccctggcaccctcctccaagagcacctctgggggcacagcggcccgtgggctgcctggtcaagggactacttccctagtacgtgtacg

SEQ ID NO: 457454 - DNA, 535 bp, Homo sapiens
  misc_feature: HEFZJCU01EDYWM.13.35.D02.1.454.heavy.3.raw
tcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctggggggggcttggttaagcctggggggtccctcagactctcctgtgcaacctctggattcattttctctgacgcctggttgagctgggtccgccaggctcccgggaagggctggagtgggttggccgtattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattactgtaccacagatgggccagatgcaaatggccgcgacgagttcgactacgtgggggcccggg

SEQ ID NO: 457455 - DNA, 477 bp, Homo sapiens; identical to SEQ ID NO: 444659
  misc_feature: HEFZJCU01AK3YR.16.10.A10.1.454.heavy.3.raw

SEQ ID NO: 457456 - DNA, 516 bp, Homo sapiens
  misc_feature: HEFZJCU01A374W.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccacagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagacg

SEQ ID NO: 457457 - DNA, 456 bp, Homo sapiens
  misc_feature: HEFZJCU01DLY8N.7.34.D01.1.454.heavy.3.raw
cgtgtctctacacgaccggtgctcgatttagatcgtctgtgttgggtttgggattcacgttgcagatgtaggtctgggtgcgccagatgcccgggaaaggcctggagtggatggggagcatctatcctggtgactctgataccagatacagcccgtccttccaaggccacgtcaccatctcgctcgacaagtccatcaccaccgcctacgtggagtggagcagcctgaaggcctcggacaccgcaatgtattactgtgcgaaactcgaccgagattgtcgtggtggcaggtgcttctcggaaaattcgagtcctggggccagggaaccccggtcagtgtctcctcagcctccaccaagggcccatcggtcttccccctggcaccctcctccaagagcacctctgggggcacagcggccctgggctgcctggtcaaggactacttcctagagacacg

SEQ ID NO: 457458 - DNA, 489 bp, Homo sapiens; identical to SEQ ID NO: 444591
  misc_feature: HEFZJCU01CTBMG.18.70.G04.1.454.heavy.3.raw

SEQ ID NO: 457459 - DNA, 499 bp, Homo sapiens
  misc_feature: HEFZJCU01B93E1.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaagggcccatcggtcttcccctggcgcctgctccaggagcacctccgagagcacagcggccctgggctgcctggtcaaggactacttccgtactagacg

SEQ ID NO: 457460 - DNA, 492 bp, Homo sapiens
  misc_feature: HEFZJCU01CSQHG.3.71.G05.1.454.heavy.3.raw
agacgcactccacgaccggtgctcgatttagtgtcgtcgcaagagagagggggagctctgggagaggagccccagccctgagattcccaggtgtttccattcagtgatcagcactgaacacagaggactcaccatggagttgggactgagcgtgagtttcctttaggctatttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattctgtgtaagtcccgggaaat

SEQ ID NO: 457461 - DNA, 507 bp, Homo sapiens
  misc_feature: HEFZJCU01DSABK.51.27.C05.1.454.heavy.3.raw
cgatcgtatacacgaccggtgctcgatttagacgcgatcgaagggtttggggggaagaggaagactgacggtcctcccaggagttcaggtgctgggcaccgtgggcatggggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaataaaaattatgcagactccgtgaagggccgattcaccatctccagagacaattccaagaacactctatatttgcagatgaatagcctgagaattgaggacacggctgtgtattactgtgtgagagggtcggcatattccggtttttggagtaattatctactgggaactttgatatctggggccacgggacaatggtcaccgtctcttcagcttcaccaagggcccatcggtcttcccctgcgcctgct

SEQ ID NO: 457462 - DNA, 389 bp, Homo sapiens
  misc_feature: HEFZJCU01ECREB.51.49.E05.1.454.heavy.3.raw
cgatcgtatacacgaccggtgctcgatttagagcgactagcaacacacaaagggggggaaatcagtcgtagtggagagaccttctacaacccgtccctcaagagtcgagtcgccatatcaacagacgcgtccaagagtgaggtgtccctgacactcaggtctgtgaccgccgcggacgcggctgtatactactgtgcgagagtccccgctgggttttggagtggttattatgccggtatggacgtctggggcgcagggaccacggtcgccgtctcttcagcctccaccaagggcccatcggtcttccccctggcaccctcctccaagagcacctctgggggcacagcggccctgggctgcctggtcaaggactacttcctcgtagcact

SEQ ID NO: 457463 - DNA, 490 bp, Homo sapiens; identical to SEQ ID NO: 446494
  misc_feature: HEFZJCU01BUCZ9.11.13.B02.1.454.heavy.3.raw

SEQ ID NO: 457464 - DNA, 487 bp, Homo sapiens
  misc_feature: HEFZJCU01B5SV0.47.85.H08.1.454.heavy.3.raw
agctcacgtacacgaccggtgctcgatttagtatcactcagtcggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggcccagggaaccctggtcatcgtctcctcagcctccaccaagggcccatcggtcttcccctggcgccctgctccaggagcacctccgagagcacagcggcctgggctgcctggtcaaggactacttcctacgtgagct

SEQ ID NO: 457465 - DNA, 477 bp, Homo sapiens; identical to SEQ ID NO: 444659
  misc_feature: HEFZJCU01BJZYS.16.10.A10.1.454.heavy.3.raw

SEQ ID NO: 457466 - DNA, 492 bp, Homo sapiens
  misc_feature: HEFZJCU01D5W0E.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacacgctgtatctgcaattgaacagcctgagagccgaggacacggccgtattatactgtgcgaagatttggggaatgaccactc

SEQ ID NO: 457467 - DNA, 538 bp, Homo sapiens
  misc_feature: HEFZJCU01EHHR7.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattagacagtctgacgacccgaggacacggctgtgtattactgtgcaaggcagttcgtggaaacagttatgggttggggggtagtttggggttttttttcgttacgttacgggattc

SEQ ID NO: 457468 - DNA, 509 bp, Homo sapiens
  misc_feature: HEFZJCU01B48U4.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggttccgcggtccggggt

SEQ ID NO: 457469 - DNA, 506 bp, Homo sapiens; identical to SEQ ID NO: 445682
  misc_feature: HEFZJCU01ETCFB.48.44.D11.1.454.heavy.3.raw

SEQ ID NO: 457470 - DNA, 528 bp, Homo sapiens; identical to SEQ ID NO: 448261
  misc_feature: HEFZJCU01D786C.18.33.C11.1.454.heavy.3.raw

SEQ ID NO: 457471 - DNA, 465 bp, Homo sapiens; identical to SEQ ID NO: 444805
  misc_feature: HEFZJCU01BSU9M.19.10.A10.1.454.heavy.3.raw

SEQ ID NO: 457472 - DNA, 528 bp, Homo sapiens
  misc_feature: HEFZJCU01CVOK1.16.27.C05.1.454.heavy.3.raw
  modified_base (519)..(519): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactggggccggggagccccgggtnatcgtctcc

SEQ ID NO: 457473 - DNA, 503 bp, Homo sapiens
  misc_feature: HEFZJCU01DV5FA.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaaggggctggagtgggtttcatatattgatagaaatagtggaaccatatactatgcagactctgtgaggggccgattcaccatctccagagacaatgccaggaattcactgatgtggaaatgaacagtctgagagccgagacacggctctctattactgtgcgagagccccgaaaatacggtctaacg

SEQ ID NO: 457474 - DNA, 498 bp, Homo sapiens
  misc_feature: HEFZJCU01CDNA8.12.14.B03.1.454.heavy.3.raw
atacgacgtacacgaccggtgctcgatttagtgtgagtagttccgcgggggggggaggcttggttcggcctggcgggtccctgagactctcctgcgcagcctctggattcctttttgaggattttgccatgcactgggtccggcaagctccgggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaaggggctctggttcagggatggggctttgactcctgggcccagggaaccctggtcgcggtctcctcagcctccaccaagggcccatcggtcttccccctggcaccctcctccaagagcacctctgggggcacagcggccctgggctgcctggtcaaggactacttcctacgtcgtat

SEQ ID NO: 457475 - DNA, 379 bp, Homo sapiens; identical to SEQ ID NO: 444450
  misc_feature: HEFZJCU01AR3K5.47.77.G11.1.454.heavy.3.raw

SEQ ID NO: 457476 - DNA, 518 bp, Homo sapiens
  misc_feature: HEFZJCU01EWGNN.48.62.F07.1.454.heavy.3.raw
agtatacatacacgaccggtgctcgatttagtagtcgcataaagggaaagggggctttctgagagtcagggatctcatgtgcaagaaaatgaagcacctgtggttcttcctcctgctggtggcggctcccagatgggtcctgtcccagctgcagctgcaggagtcgggcccaggactggtgaagctttcggagaccctgtccctcacctgcactgtctctggtggctccatcagcagtagtagttactactggggttggatccgccagcccccagggaaggggctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactgtgtgagacgggtgccccaagaaaagtgtttatcctgggccagggaaccctggtcaccgtctcctcagcctccaccaagggccc

SEQ ID NO: 457477 - DNA, 402 bp, Homo sapiens; identical to SEQ ID NO: 444815
  misc_feature: HEFZJCU01D6ST9.11.70.G04.1.454.heavy.3.raw

SEQ ID NO: 457478 - DNA, 510 bp, Homo sapiens
  misc_feature: HEFZJCU01DQIMH.51.30.C08.1.454.heavy.3.raw
cgatcgtatacacgaccggtgctcgatttagtctgacgtcaaagggaaaggggaggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagttgctgggaaggacatactacaggtccaagtggtttaatgattatgcagtatctgtgaaagtcgaataaccatcaacccagacacatccaagaaccagttctccctgcaactgaactctgtgactcccgaggacacggccgtgtattactgtgcaagaggttggttaacagctggaggatttgactacgtggggccagggaaccctggtcaccgtctcctcagcctccaccaacgggcccatccggtcttcccctggccgccctgctccaggacgcacctccgagacgcacacgcggccc

SEQ ID NO: 457479 - DNA, 506 bp, Homo sapiens
  misc_feature: HEFZJCU01D6U4D.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtgggttgggtcagcgcttaccaagttggctacacaaattatgcacagaagttccaggacagagtcaccatgaccacagacacatccacgagcacagcctacatggaactgaggagcctgagatctgacgacacggccgtatatttctgcgcgagagacgtaaagtgacgtggtagttccggggggacacatgacaccg

SEQ ID NO: 457480 - DNA, 505 bp, Homo sapiens
  misc_feature: HEFZJCU01ENDZ0.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagagtacgggcagcacggtgggtttgggggctacgtggggccagggaacccgtggtccaccgtctcctcacgcctccaaccg

SEQ ID NO: 457481 - DNA, 521 bp, Homo sapiens
  misc_feature: HEFZJCU01DCE2H.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgccctgctccaggagcacctccgagagcacagcggcccc

SEQ ID NO: 457482 - DNA, 515 bp, Homo sapiens
  misc_feature: HEFZJCU01DOBOH.49.20.B09.1.454.heavy.3.raw
agtcgagagacacgaccggtgctcgatttagtgtagtgtgaaggggacccaacaaccacatccctcctcagaagcccccagagcacaacgcctcaccatggactggacctggaggatcctctttttggtggcagcagccacaggtgcccactcccaggtccagcttgtgcagtctggggctgagttgaagaagcctggggcctcagtgagggtttcctgcgtggtctccggatacaccttcactagtcatcctatgcattgggtgcgccaggcccccggacaaaggtttgagtggatgggatggatcaccgctggcaatggtgacacaaaatattcagagaagttccagggcagagtctccattaccagggacacagctgcgagtacagggtacatggaactgagtggcctgagatctgaggacacggctgtttattactgtgcgaggagggaagtgggatagttgtggcagctccgaggtcgcccaggcccgggcccttacgtttgactacgtc

SEQ ID NO: 457483 - DNA, 526 bp, Homo sapiens
  misc_feature: HEFZJCU01CU3GE.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggacctacc

SEQ ID NO: 457484 - DNA, 537 bp, Homo sapiens
  misc_feature: HEFZJCU01BMQ0N.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccagggagccctgggtccaccg

SEQ ID NO: 457485 - DNA, 535 bp, Homo sapiens
  misc_feature: HEFZJCU01C0YTE.7.78.H01.1.454.heavy.3.raw
cgtgtctctacacgaccggtgctcgatttagtgtgagtagtttgggtttggggacccaacaaccacacccctcctaagaagaagccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacggggcggtttgtcttctccatggatacctctgtcgggacggcttatctgcagataaccaacttcaacctgacgacactgccgtttattttgtacgagagcgtcgtctgtcagtggaattgactactggggccagggaaccctggtcaccgtctcctcagcctccaccaagggcccacg

SEQ ID NO: 457486 - DNA, 526 bp, Homo sapiens
  misc_feature: HEFZJCU01CBVSE.48.35.D02.1.454.heavy.3.raw
agtatacatacacgaccggtgctcgatttagcacacgatagttgggtttggggggattttcaggtgttttcatttggtgatcaggactgaacagagagaactcaccatggagtttgggctgagctggctttttctagtgactatttttaaaggtgtccagtgtgaggtgcaactattggagtctgggggtggcctggtgcagccgggggggtccctgagactctcttgtgcagcctctggattcagctttagtaattatgccatgagctgggtccgccaggctccagggaaggggctggagtggatttcatctattagtggtagtggtgttaccacatactacgcagactccgtgaagggccgattcatcatctccagagacagttccaggaacacactggatttgcaaatgaacagcctgagagccgaggacacggccctatattactgtgcgaaatcccatgatagtagttggtttttcttttcgttctttgaccactggggccagggatccctgctctacccg

SEQ ID NO: 457487 - DNA, 518 bp, Homo sapiens
  misc_feature: HEFZJCU01DUHEH.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctagttaaaactcctactacggtctggacgtctggggccaggggaccaa

SEQ ID NO: 457488 - DNA, 526 bp, Homo sapiens
  misc_feature: HEFZJCU01BXDRC.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgaggactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctcccaccctccaccaagggcccatcggtcttcccctggcaccctcctccaagagcacctctgggggcacagcggccctgggctgcctggtcaaggactacttcccatactcgta

SEQ ID NO: 457489 - DNA, 528 bp, Homo sapiens; identical to SEQ ID NO: 446542
  misc_feature: HEFZJCU01EUN2U.7.70.G04.1.454.heavy.3.raw

SEQ ID NO: 457490 - DNA, 523 bp, Homo sapiens
  misc_feature: HEFZJCU01BXA8W.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggccg

SEQ ID NO: 457491 - DNA, 502 bp, Homo sapiens
  misc_feature: HEFZJCU01DDFST.21.19.B08.1.454.heavy.3.raw
tcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccaggaaaggggctggagtggctctcacagattagtggtagtagtagtttcatatattacgcagactcagtgcagggccgattcaccatctccagagacaacgccaagaattccctgtatctgcaaatggacagcctgagagtcgaggacacggctatgtattactgtgcgggtggcgtggggcggggatgacagctgggccac

SEQ ID NO: 457492 - DNA, 499 bp, Homo sapiens
  misc_feature: HEFZJCU01B2B5Q.17.74.G08.1.454.heavy.3.raw
cgtagactagcacgaccggtgctcgatttagtagctctatcagggtcttcgtggctcacgtccaccaccacgcatgtgacctcaggggtccctgagactctcctgtgcagcctctggattcaccttcagtacctactggatgcactgggtccgccaagctccagggaaggggctggagtggctctcacgtgttgataatgttggcagtttcacaaatacgcggactccgtgaagggccgattcaccatctccagagacaacgccaagaacacgctgtatctgcaaatgaacagtctgagagccgaggacacggctgtttattactgtgcaagacagcactacagtcactacttcgaccctgggccagggaaccctggtcaccgtctcctcagcctccaccaaggcccatcggtcttccccctggcaccctcctccaagagcacctctgggggcacacgcggcctgggctgcctggtcaggactacttccctagtctacg

SEQ ID NO: 457493 - DNA, 418 bp, Homo sapiens; identical to SEQ ID NO: 446028
  misc_feature: HEFZJCU01EZ6Q4.16.28.C06.1.454.heavy.3.raw

SEQ ID NO: 457494 - DNA, 402 bp, Homo sapiens; identical to SEQ ID NO: 444584
  misc_feature: HEFZJCU01D7BXU.10.77.G11.1.454.heavy.3.raw

SEQ ID NO: 457495 - DNA, 399 bp, Homo sapiens
  misc_feature: HEFZJCU01C57KO.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactactcctacgtgagct

SEQ ID NO: 457496 - DNA, 379 bp, Homo sapiens; identical to SEQ ID NO: 444450
  misc_feature: HEFZJCU01A39U4.47.77.G11.1.454.heavy.3.raw

SEQ ID NO: 457497 - DNA, 490 bp, Homo sapiens
  misc_feature: HEFZJCU01DR4YO.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggccccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccatgggcccatcggtcttcccctggcgccctgctccaggagcacctccgagagcacagcggccctgggctgcctggtcaaggactacttcccatactcgta

SEQ ID NO: 457498 - DNA, 533 bp, Homo sapiens
  misc_feature: HEFZJCU01C8C2B.52.53.E09.1.454.heavy.3.raw
cgcagtacgacacgaccggtgctcgatttagagagagtgtgttgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagccccgtaacttctggggccagggaacccgggtcaccgtctcctcagcctccaccaagggcccatcggtcttccccctggcaccctcctccaagagcacctctgggggcacagcggccctgggctgcctggtcaaggacta

SEQ ID NO: 457499 - DNA, 511 bp, Homo sapiens
  misc_feature: HEFZJCU01ALC0F.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagtttattagtcccttactttgacttacgtggggccaggggaactctggtcaccgtcctccgcagcctccacc

SEQ ID NO: 457500 - DNA, 500 bp, Homo sapiens; identical to SEQ ID NO: 445720
  misc_feature: HEFZJCU01CRX69.3.20.B09.1.454.heavy.3.raw

SEQ ID NO: 457501 - DNA, 507 bp, Homo sapiens
  misc_feature: HEFZJCU01EXB8G.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaaggggactgacatctgacgacacggccatgtattattgtgcgagagaaatgttaggtactgctttgggtccctggggcccggaacccggggtc

SEQ ID NO: 457502 - DNA, 507 bp, Homo sapiens
  misc_feature: HEFZJCU01DDSF5.53.33.C11.1.454.heavy.3.raw
cgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctgggggccagggaaccctggtcaccgtctcctcagcttccaccaagggcccatcggtccttcccctcggcg

SEQ ID NO: 457503 - DNA, 522 bp, Homo sapiens
  misc_feature: HEFZJCU01BRQ8L.12.40.D07.1.454.heavy.3.raw
atacgacgtacacgaccggtgctcgatttagtgatagagcgtaacaacagagggctcaccatggagtttgggctgagcgtgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctcaccaagggcccatcggtcttcccctggcg

SEQ ID NO: 457504 - DNA, 483 bp, Homo sapiens
  misc_feature: HEFZJCU01C6AP4.47.59.F04.1.454.heavy.3.raw
agctcacgtacacgaccggtgctcgatttagtacacacacttagggattgggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttccccctggccgccctgctccaggagcacctccgagagcacagcggccctgggctgcctggtcaaggctactcctacgtgagct

SEQ ID NO: 457505 - DNA, 524 bp, Homo sapiens
  misc_feature: HEFZJCU01DO1DM.9.37.D04.1.454.heavy.3.raw
tgatacgtctcacgaccggtgctcgatttagtagcatactgttgggtttgggggagccctggtacagccgggggggtccctgacactctcctgtacagcctctggattcacctttaacacctatgcattgagctgggtccgccaggccccagggaaggggctggactgggtcgcagccattagtggcaatggcgaaaacacatattacgcagactccgtgaagggccggttcaccatttccagagacaatttcaagaacacgctgtatctgcagatgaacagcctgagagccgaggacacggccgtatatcactgtgccaaagatcagaaggacggttcggggagttacaaatattactacttctactatggaatggacgtctggggccgagggaccacggtcaccgtctcctcagcctccaccaagggcccatcggtcttcccctggcaccctcctccaagagcacctctgggggcacagcggccctgggctgcctggtcaaggactacttccagacgtatca

SEQ ID NO: 457506 - DNA, 521 bp, Homo sapiens
  misc_feature: HEFZJCU01AHKZF.53.17.B06.1.454.heavy.3.raw
cgcgtatacacacgaccggtgctcgatttagtcgatagtgaagggggctctgggagaggagcccagcactagaagtcggcggtttttccattcggtgatcagcactgaacacagaggactcaccatggactgttaagaggtgtgtcgagcactgggtccgccaggctccaggcaaggggctgaagtgactgccacttaacatcagatgatcgaatcaataggttttatgcggactcggtgaggggccgattcaccgtctccggagacaattccaagaatacgagataggtgcaaatgaagaccctgggacttgaagacacgggtgcgtcttcctgtgcgactgtgtcccaacgttgtattctttgagtggacgtctcgagaacaagggaccacggtcatcgtctcctccgatgagactgaccactctggggcctttgatttccgccactgcctgtggaatttccgcactagtggagcctccaccaagggcccatcggtcttccccctggccaccctcctcc

SEQ ID NO: 457507 - DNA, 379 bp, Homo sapiens; identical to SEQ ID NO: 444450
  misc_feature: HEFZJCU01ENN9U.47.77.G11.1.454.heavy.3.raw

SEQ ID NO: 457508 - DNA, 505 bp, Homo sapiens
  misc_feature: HEFZJCU01DE3U5.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccac

SEQ ID NO: 457509 - DNA, 529 bp, Homo sapiens
  misc_feature: HEFZJCU01A640O.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatccctgaaagcgtacaactactactactacgtatggacctctggg

SEQ ID NO: 457510 - DNA, 522 bp, Homo sapiens
  misc_feature: HEFZJCU01CC9X4.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttgggccagggaaccctggtcaccgtctcctcagcctccaccaagggcccatcggtcttcccctggcgccctgctccaggagcacctccgagagcacagcggcctgggctgcctggtcaaggactacttcc

SEQ ID NO: 457511 - DNA, 504 bp, Homo sapiens; identical to SEQ ID NO: 445648
  misc_feature: HEFZJCU01C2ECR.17.25.C03.1.454.heavy.3.raw

SEQ ID NO: 457512 - DNA, 500 bp, Homo sapiens
  misc_feature: HEFZJCU01EN7CT.19.26.C04.1.454.heavy.3.raw
tactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctgggggacacggctgtgtattactgtgcgagagcggctggcaactacatccatttac

SEQ ID NO: 457513 - DNA, 520 bp, Homo sapiens
  misc_feature: HEFZJCU01EJEND.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtcgtggggccaagggaccg

SEQ ID NO: 457514 - DNA, 528 bp, Homo sapiens
  misc_feature: HEFZJCU01CK68Q.48.26.C04.1.454.heavy.3.raw
agtatacatacacgaccggtgctcgatttagtctagcgactttgggtttggggggaagaggaagactgacggtccccccaggagttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttactatggttcggggagtctccgacccagcaactggttcgaccctggggccagggaaccctggtcaccgtctcctcagcctccaccaagggcccatcggtcttccccctggcaccctcctccaagagcacctctgggggcacacg

SEQ ID NO: 457515 - DNA, 423 bp, Homo sapiens; identical to SEQ ID NO: 446550
  misc_feature: HEFZJCU01EVUAZ.11.22.B11.1.454.heavy.3.raw

SEQ ID NO: 457516 - DNA, 526 bp, Homo sapiens
  misc_feature: HEFZJCU01DIF7N.14.55.E11.1.454.heavy.3.raw
cgtctagtaccacgaccggtgctcgatttagcactcgcacgttgggtttggggggaagaggaagactgacggtcccccaggagttcaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggaggggtggtgatccaggtatgattgtgtactactaccacggtctggacgtctggggccaagggaccacggtcaccgtctcctcagcctccaccaagggcccatcggtccttcccctggcaccctcctccaagagcacctcgtgggggcacagcggcctgggctgcctggtcaaggactacttaccg

SEQ ID NO: 457517 - DNA, 508 bp, Homo sapiens
  misc_feature: HEFZJCU01ENNOQ.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctgggtcaccgtctcctcagcctccaccaaggcccatcggtcttcccctggcgccctgctccaggagcacctccgagagcacagcggccctgggctgcctggtcaaggactacttccagacgtatca

SEQ ID NO: 457518 - DNA, 499 bp, Homo sapiens; identical to SEQ ID NO: 447792
  misc_feature: HEFZJCU01BG9JW.17.10.A10.1.454.heavy.3.raw

SEQ ID NO: 457519 - DNA, 518 bp, Homo sapiens
  misc_feature: HEFZJCU01C7VAD.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaaggcccatcggtcttccccctggcaccctcctccaagagcacctctgggggcacagcggccctgggctgcctggtcaaggactacttccgagtagtaca

SEQ ID NO: 457520 - DNA, 521 bp, Homo sapiens
  misc_feature: HEFZJCU01DKW45.53.33.C11.1.454.heavy.3.raw
cgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagttggtttggtaccgttcgacccgtggggccagggaaccctggtcaccgtctcctcagcttccaccgaacgggccctagtccggttccttccccctcggccgtccccg

SEQ ID NO: 457521 - DNA, 483 bp, Homo sapiens; identical to SEQ ID NO: 444924
  misc_feature: HEFZJCU01AURXO.10.35.D02.1.454.heavy.3.raw

SEQ ID NO: 457522 - DNA, 516 bp, Homo sapiens
  misc_feature: HEFZJCU01CMVGU.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcaccctgggccagggaaccctggtcaccgtctcctcagcctccaccaagggcccatcggtcttcccctggcaccctcctccaagagcacctctgggggcacagcggccctgggctgcctggtcaaggactacttccgagtagtacac

SEQ ID NO: 457523 - DNA, 489 bp, Homo sapiens; identical to SEQ ID NO: 444591
  misc_feature: HEFZJCU01D6L9J.18.70.G04.1.454.heavy.3.raw

SEQ ID NO: 457524 - DNA, 487 bp, Homo sapiens
  misc_feature: HEFZJCU01BQ2QK.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattattgtgtccttgattacta

SEQ ID NO: 457525 - DNA, 467 bp, Homo sapiens; identical to SEQ ID NO: 454435
  misc_feature: HEFZJCU01DHVMA.9.34.D01.1.454.heavy.3.raw

SEQ ID NO: 457526 - DNA, 508 bp, Homo sapiens
  misc_feature: HEFZJCU01DIRK2.3.85.H08.1.454.heavy.3.raw
agacgcactccacgaccggtgctcgatttagtatcactcagtcgcggggagctctgagagaggagcccagccctgggattttcaggtgttttcatttggtgatcaggactgaacagagagaactcaccatggagtttgggctgagcgtggcttttcttaggtggctattttaaaaggtgtccagtgtgaggtgcagctggtggagtctgggggaggcttggtacagcctggggggtccctgagactctcctgtgcagcctctggattcacctttagtaattatgccatgagctgggtccgccaggctccagggaaggggctggagtgggtctcagctattagtgatcgtggtggtaacacatactacgcagactccgtgaagggccgcttcaccatctccagagacaattccaagaacacgctgcatctgcaaatgaacagcctgagagccgaggacacggccctttattactgtgcgaaaccaatcacgtataactggaactacgta

SEQ ID NO: 457527 - DNA, 501 bp, Homo sapiens
  misc_feature: HEFZJCU01C56XV.3.71.G05.1.454.heavy.3.raw
agacgcactccacgaccggtgctcgatttagtgtcgtcgcaagagagagggggctgggagaggagccccagccctgagattcccaggtgtttccattcagtgatcagcactgaacacagaggactcaccatggagttgggactgagcgtggagtttccttttaggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgtgtaaagtcccggggaaatatgtacg

SEQ ID NO: 457528 - DNA, 537 bp, Homo sapiens
  misc_feature: HEFZJCU01CS5FR.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgttacgtagagcgtcgtctgtcagtggaattgactactggggccagggaaccctggtcaccgtctcctcagcctccaccagggaccc

SEQ ID NO: 457529 - DNA, 450 bp, Homo sapiens
  misc_feature: HEFZJCU01DE5JT.49.12.B01.1.454.heavy.3.raw
agtcgagagacacgaccggtgctcgatttagtagtgtagattccgcgggcacgaccggtgctcgatttagtagtgtagattccgcgggcacgaccggtgctcgatttagtgtagtgtgaagggaaaggggctggagtgggtctcacttatttatagtggcggtaacacaaggtacgcagactccgtgaggggccgattcaccatctccagagacagttccaagaacaccctgtatcttcaaatgaacagtctgagacctgacgacacggctgtctattactgtgcagtattcgcctctcttgagtactggggccagggatccctggtcatcgtctcctcagcctccaccaagggcccatcggtcttccccctggcgccctgctccaggagcacctccgagagcacagcggccctgggctgcctggtcaaggactacttcctctctcgact

SEQ ID NO: 457530 - DNA, 492 bp, Homo sapiens
  misc_feature: HEFZJCU01DFJ9F.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgtagt

SEQ ID NO: 457531 - DNA, 482 bp, Homo sapiens; identical to SEQ ID NO: 444503
  misc_feature: HEFZJCU01CLMR1.7.10.A10.1.454.heavy.3.raw

SEQ ID NO: 457532 - DNA, 510 bp, Homo sapiens
  misc_feature: HEFZJCU01CMQ1U.51.13.B02.1.454.heavy.3.raw
cgatcgtatacacgaccggtgctcgatttagtctagcgacttccgcggggacccaaaaaccacacccctccttgggagaatcccctagatcacagctcctcaccatggactggccctggaacatccttttcttggtggcagcagcaacaggtgcccactccgaggctcagctggtgcagtctggacctgaggtgcagaagcctggggcctcagtgaaagtctcctgcagggcctctgatttcaccttttccaactatggtttcgcttgggtgcgacaggcccctggacagggcctggagtggctgggatggatcagcactgacagactgaatattaatatgcacagggtctccagggcagagtcaccgtgtccgcagacacgtccacgggcacggcctatatggaattgaggagcctcagatatgacgacacggccgtcgtattactgtgccagaggggccgtttgggggagttatggtccctgtgctttggatgtctggggccaaggga

SEQ ID NO: 457533 - DNA, 494 bp, Homo sapiens
  misc_feature: HEFZJCU01CTLHA.51.35.D02.1.454.heavy.3.raw
cgatcgtatacacgaccggtgctcgatttagcacacgatagttgggtttgggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggcctgggctgcctggtcaaggactacttcctcgtagcact

SEQ ID NO: 457534 - DNA, 400 bp, Homo sapiens; identical to SEQ ID NO: 444452
  misc_feature: HEFZJCU01A8EUI.47.24.C02.1.454.heavy.3.raw

SEQ ID NO: 457535 - DNA, 528 bp, Homo sapiens
  misc_feature: HEFZJCU01D1HPQ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctggggccaggggaccctggtcatcgtctccccagcctccaccaaggcccatcggtccttccccctggccgccctcg

SEQ ID NO: 457536 - DNA, 489 bp, Homo sapiens
  misc_feature: HEFZJCU01D4IOT.10.85.H08.1.454.heavy.3.raw
catagtagtgcacgaccggtgctcgatttagtatcactcagtcgggggctgggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccaccaagggcccatcggtcttccccctggcgccctgctccaggagcacctcccgagagcacagcggccctgggctgcctggtcaaggactacttcccactactatg

SEQ ID NO: 457537 - DNA, 511 bp, Homo sapiens; identical to SEQ ID NO: 448280
  misc_feature: HEFZJCU01DLPBZ.16.71.G05.1.454.heavy.3.raw

SEQ ID NO: 457538 - DNA, 522 bp, Homo sapiens
  misc_feature: HEFZJCU01B74O5.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctggggcc

SEQ ID NO: 457539 - DNA, 465 bp, Homo sapiens; identical to SEQ ID NO: 444805
  misc_feature: HEFZJCU01CXV55.19.10.A10.1.454.heavy.3.raw

SEQ ID NO: 457540 - DNA, 509 bp, Homo sapiens
  misc_feature: HEFZJCU01EP8RA.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatgaccacgaactcctccataaacacagcctacatggagttgaggagcctgacatctgacgacacggccgtctattactgtgcgagagtcccacgatccgggtgacgcctacggcaggcggtcctttgacttcgtc

SEQ ID NO: 457541 - DNA, 475 bp, Homo sapiens; identical to SEQ ID NO: 445138
  misc_feature: HEFZJCU01CA9MC.3.39.D06.1.454.heavy.3.raw

SEQ ID NO: 457542 - DNA, 523 bp, Homo sapiens
  misc_feature: HEFZJCU01BBOOT.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttcc

SEQ ID NO: 457543 - DNA, 504 bp, Homo sapiens; identical to SEQ ID NO: 448739
  misc_feature: HEFZJCU01CKLPC.52.70.G04.1.454.heavy.3.raw

SEQ ID NO: 457544 - DNA, 396 bp, Homo sapiens
  misc_feature: HEFZJCU01D8JQM.47.46.E02.1.454.heavy.3.raw
agctcacgtacacgaccggtgctcgatttagactcatctacagggaaagggactggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 457545 - DNA, 469 bp, Homo sapiens; identical to SEQ ID NO: 449151
  misc_feature: HEFZJCU01B77F1.4.36.D03.1.454.heavy.3.raw

SEQ ID NO: 457546 - DNA, 503 bp, Homo sapiens
  misc_feature: HEFZJCU01BKROM.17.10.A10.1.454.heavy.3.raw
  modified_base (461)..(461): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggaccacccccacgaacacagtctacatgcaactgacgagcctgagagctgacgacacggccgtctattactgtgcgagaatgttttcngtcatcgtacaatttgataggctctatggactggacttcgtc

SEQ ID NO: 457547 - DNA, 491 bp, Homo sapiens
  misc_feature: HEFZJCU01AZXAR.53.61.F06.1.454.heavy.3.raw
cgcgtatacacacgaccggtgctcgatttagctacgctctaagggaaagggggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctagtggagtctgggggaggcgtcgtccaccctggggggtccctgagactctcctgtgcagcctctggattcaccttcagagtctatggcatgcactgggtccgccaggctccaggcaaggggctggagtgggtggcacttatatcagatgatggaagtgatacatactatggagactccgtgaagggccgattcacatctcgagagacaattccaggaacacgctgtatctgcaaatgaacggcctgagagctgaggacacggctgtgtattactgtgcgtaaacggtttgagt

SEQ ID NO: 457548 - DNA, 324 bp, Homo sapiens; identical to SEQ ID NO: 444475
  misc_feature: HEFZJCU01C0JAP.18.17.B06.1.454.heavy.3.raw

SEQ ID NO: 457549 - DNA, 409 bp, Homo sapiens; identical to SEQ ID NO: 444519
  misc_feature: HEFZJCU01ES97L.3.41.D08.1.454.heavy.3.raw

SEQ ID NO: 457550 - DNA, 499 bp, Homo sapiens
  misc_feature: HEFZJCU01DM251.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcagtggcttttgatgcctttgatatgtggggccgaagggacaatggtcaccgtctt

SEQ ID NO: 457551 - DNA, 400 bp, Homo sapiens
  misc_feature: HEFZJCU01BC9LT.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctctgggggcacagcggccctgggctgcctggtcaaggactacttcctacgtgagct

SEQ ID NO: 457552 - DNA, 385 bp, Homo sapiens
  misc_feature: HEFZJCU01A6IPT.13.58.F03.1.454.heavy.3.raw
tcacgtactacacgaccggtgctcgatttagtctgatcgagaagggaaggggctggagtgggtttcatatatcactggtgatagtgcttccacatattacgcagactctatgaagggccgattcaccatctccagagacaatgccaggaactcgctgtatctgcaaatgaacagcctgagagcccgaggacacggctgtctattactgtgcgaaagccagggggcggtttattgactactggggccagggaagtcctggtcaccgtctcctccagccgtccaccaagggcccatcggtcttccccctggcaccctcctccaagagcacctctgggggcacagcggccctgggctgcctggtcaaggactacttcctagtacgtga

SEQ ID NO: 457553 - DNA, 534 bp, Homo sapiens; identical to SEQ ID NO: 446321
  misc_feature: HEFZJCU01EVGYD.22.38.D05.1.454.heavy.3.raw

SEQ ID NO: 457554 - DNA, 316 bp, Homo sapiens; identical to SEQ ID NO: 444479
  misc_feature: HEFZJCU01CGOUA.47.84.H07.1.454.heavy.3.raw

SEQ ID NO: 457555 - DNA, 508 bp, Homo sapiens
  misc_feature: HEFZJCU01CJV2P.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattatttgtgtcgttagtttacggacgattacgtacgttttagatttgggtacg

SEQ ID NO: 457556 - DNA, 511 bp, Homo sapiens; identical to SEQ ID NO: 451481
  misc_feature: HEFZJCU01CE5IC.13.76.G10.1.454.heavy.3.raw

SEQ ID NO: 457557 - DNA, 379 bp, Homo sapiens; identical to SEQ ID NO: 445848
  misc_feature: HEFZJCU01BMXHI.2.86.H09.1.454.heavy.3.raw

SEQ ID NO: 457558 - DNA, 505 bp, Homo sapiens
  misc_feature: HEFZJCU01CPJYH.22.11.A11.1.454.heavy.3.raw
acatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctagtggagactggaggagccttgatccagcctggggggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccgcgggggtcacccaattgtaa

SEQ ID NO: 457559 - DNA, 523 bp, Homo sapiens
  misc_feature: HEFZJCU01EOEK8.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttattatagtagtggtagtacatactccgcagactccgtgaggggccgattcaccatctccagagacaattccaagaacacgctgtttcttcaaatgaacagcctgagagccgatgacacggccgtgtattactgtgcgagagagtcggggcccacgaacgttactacgctagtggacgtcgtggggccaaggggacccg

SEQ ID NO: 457560 - DNA, 524 bp, Homo sapiens; identical to SEQ ID NO: 451870
  misc_feature: HEFZJCU01CDGZ6.11.25.C03.1.454.heavy.3.raw

SEQ ID NO: 457561 - DNA, 515 bp, Homo sapiens
  misc_feature: HEFZJCU01EJ77J.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaagggcccatcggtcttccccctggccgccctgctccaggagcacctcgtgggggcacagccggccctgggctgcctggtcaaggactactcccatacc

SEQ ID NO: 457562 - DNA, 509 bp, Homo sapiens
  misc_feature: HEFZJCU01APAAN.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagctttgatctctggggccaagggacactggtcaccgtctcttcagcctccaccaagggcccatcggtcttccccctggccgccctgctccacggacg

SEQ ID NO: 457563 - DNA, 379 bp, Homo sapiens; identical to SEQ ID NO: 444773
  misc_feature: HEFZJCU01AY4JN.3.59.F04.1.454.heavy.3.raw

SEQ ID NO: 457564 - DNA, 528 bp, Homo sapiens
  misc_feature: HEFZJCU01C0SHZ.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggccgcctcgctccaggagcacctccgagacg

SEQ ID NO: 457565 - DNA, 526 bp, Homo sapiens
  misc_feature: HEFZJCU01DPGL4.7.78.H01.1.454.heavy.3.raw
  modified_base (511)..(511): a, c, t, g, unknown or other
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcacgtcnctcagcctcaccagg

SEQ ID NO: 457566 - DNA, 518 bp, Homo sapiens
  misc_feature: HEFZJCU01BLPN4.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagcgtgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggactctggggccaagggacc

SEQ ID NO: 457567 - DNA, 536 bp, Homo sapiens
  misc_feature: HEFZJCU01CTPHX.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctacaagagatgattacaaaaagcaacgctgtatctgacaaatgaacagcctgagaaccgaggacacagccgtgtattactgtaccacactccctagaaagcgtcaactactactactacggtatgacctc

SEQ ID NO: 457568 - DNA, 390 bp, Homo sapiens; identical to SEQ ID NO: 444541
  misc_feature: HEFZJCU01EZP7W.16.24.C02.1.454.heavy.3.raw

SEQ ID NO: 457569 - DNA, 392 bp, Homo sapiens; identical to SEQ ID NO: 444682
  misc_feature: HEFZJCU01A716Y.16.70.G04.1.454.heavy.3.raw

SEQ ID NO: 457570 - DNA, 502 bp, Homo sapiens; identical to SEQ ID NO: 445414
  misc_feature: HEFZJCU01D02VT.17.25.C03.1.454.heavy.3.raw

SEQ ID NO: 457571 - DNA, 498 bp, Homo sapiens
  misc_feature: HEFZJCU01DEWZ8.14.25.C03.1.454.heavy.3.raw
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcgtggtttccgtcgttaggctctttaagtaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgttgggagagatggaggtcgatattgt

SEQ ID NO: 457572 - DNA, 402 bp, Homo sapiens
  misc_feature: HEFZJCU01C2D3V.51.3.A03.1.454.heavy.3.raw
cgatcgtatacacgaccggtgctcgatttagagagcgtcacaggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggggttcctgcatggtttctggatattccctgactagtcatgctatgcattgggtgcgccaggcccccggacaaagctttgagtgggatgggatggatcaccgctggcaatggtgacacaaaatattcacagaagttccagggcagagtcaccattaacagggacacatctgcgagtacaggctacatggaa

SEQ ID NO: 457573 - DNA, 508 bp, Homo sapiens
  misc_feature: HEFZJCU01CHH1R.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactgaggagcctgagatctgacgacacggccgtatatttcttgcgcgagagacgtaaaagtgacgtggtattccggggggacacgatgacaccg

SEQ ID NO: 457574 - DNA, 514 bp, Homo sapiens
  misc_feature: HEFZJCU01DLPSK.51.31.C09.1.454.heavy.3.raw
  modified_base (445)..(445): a, c, t, g, unknown or other
cgatcgtatacacgaccggtgctcgatttagacgtctcatcaaggaaggaaggggagctctgagagaggagcccagccctgggattttcaggtgttttcatgtggtgatcaggactgaacagagagaactcaccatggagtctgggctgacgtggctttttcttgtggctattttaaaaggtgtccagtgtgacgtgcagctggtggagtctgggggaggcttgatacagccgggggggtccctgagactctcatgtagaacctctggcttcatgtttagagtctatgacatgagttgggtccgccaggctccggggaaggggctggagtgggtctcaatgatcagtgatggtggaacgaccacaaactacgccgactccgtgaagggccggtgcaccatctccagagacaattcgaaggacactttatatctgcaactcaacanactgacacccgcggacacggccgtctactactgtgtgaaagaagacggaccgctggacgaggagccaga

SEQ ID NO: 457575 - DNA, 400 bp, Homo sapiens; identical to SEQ ID NO: 444452
  misc_feature: HEFZJCU01A8S9G.47.24.C02.1.454.heavy.3.raw

SEQ ID NO: 457576 - DNA, 523 bp, Homo sapiens
  misc_feature: HEFZJCU01CBBEE.47.46.E02.1.454.heavy.3.raw
agctcacgtacacgaccggtgctcgatttagactcatctacagggaaagggggagagaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtctgggggagacttagtacaccctggggggtccctgagactctcctgtgcagcctctggactcacctttagcaactctgtcatgggctgggtccgccaggctccggggaagggctggagtgggtctcaagtattgatgagaatggtggaagcacattctacgtggactccgtgaagggcccggttcaccatctccaggagacaatttcaggagcacgctgtatctacaaatgaacagcctgagagccgaggacacggccgtatatttctgtgcgaagtctatagcagtcgcccctacgcgcacttctttgacttctggggcca

SEQ ID NO: 457577 - DNA, 510 bp, Homo sapiens
  misc_feature: HEFZJCU01BCUFC.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagcgtggcttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 457578 - DNA, 488 bp, Homo sapiens; identical to SEQ ID NO: 447708
  misc_feature: HEFZJCU01BKMJS.47.85.H08.1.454.heavy.3.raw

SEQ ID NO: 457579 - DNA, 324 bp, Homo sapiens; identical to SEQ ID NO: 444475
  misc_feature: HEFZJCU01CY8MQ.18.17.B06.1.454.heavy.3.raw

SEQ ID NO: 457580 - DNA, 509 bp, Homo sapiens
  misc_feature: HEFZJCU01EXAUQ.14.21.B10.1.454.heavy.3.raw
cgtctagtaccacgaccggtgctcgatttagtgtcgtcgcaggagagaggagcccagccctgggattttcaggtgttttcattcggtgatcaggactgaacagagagaactcaccatggagtttgggctgagcgtggcgttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaaccgccaagatttttggagtggttattataccttttgacttcg

SEQ ID NO: 457581 - DNA, 537 bp, Homo sapiens
  misc_feature: HEFZJCU01B79OZ.19.10.A10.1.454.heavy.3.raw
tactctcgtgcacgaccggtgctcgatttagcgtcgatctcagggggggagaggagtcccagccttggggttcccgagtgttttcgttcagtgatcaggactgaacacgtaggactcaccatggagtttggcctgagttggattttcctttctgctattttaaaaggtgtcctgtgtgaggtgcgtctggtggagtctgggggaggcgtggtccagcccggggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaatgaacagcctgaagaccgaggacacagccatttactattgtaacaaatgaatacgtgggggaacggggggaaattgggggccagggaaccctggtctccgtctcgtca

SEQ ID NO: 457582 - DNA, 506 bp, Homo sapiens
  misc_feature: HEFZJCU01DP6NC.48.19.B08.1.454.heavy.3.raw
agtatacatacacgaccggtgctcgatttagtgagtcagtaagggggagagaggagccttagccctggattccaaggcctatccacttggtgaccagcactgagcaccgagggttcaccatggaattggggctccgctgggttttcctggttgctgttttagcaggtggcagtgtgacgtgcacctgctggagtcggggggaggcctggtcaagcgggggggtccctgagactctcttgtgaagcctctaaaatcagtctcgagagttccagcatgaactgggtccgccaggctccagggaagggcctggagtgggtctcatccatcagcagtggaggcaaccatatgttgtatgccgactcagtgaggggccgattcagcgtctccagagacaacgccaagatgtcagtatatctggaatgaacaacctaagagtcgaggacacggctgtctactactgtgcgagagatgtgattccagtgactgggtgggtggttactttgact

SEQ ID NO: 457583 - DNA, 473 bp, Homo sapiens
  misc_feature: HEFZJCU01BQ03W.2.16.B05.1.454.heavy.3.raw
acgctcgacacacgaccggtgctcgatttagagctcacgtattgggtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactggggcccgggagccctggtcaccgtctcctcagcctccaccaagggcccatcggtcttccccctggcgccctgctccaggagcacctccgagagcacagcggccctgggctgcctggtcaaggactacttcctgtcgacgt

SEQ ID NO: 457584 - DNA, 503 bp, Homo sapiens
  misc_feature: HEFZJCU01DUP6V.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaactgtatcttacaaataaacagtctgagacttgaggacacggctgtctattactgtgcgagagactacggtgacctttctggtattcgatctctgggccgtggcacctggtcactgtctcctcggcttccaccaagggcccatcggtccttcccctggcgccctgctccaggacgcacctcgtggggcac

SEQ ID NO: 457585 - DNA, 485 bp, Homo sapiens
  misc_feature: HEFZJCU01BRDC8.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggagcgtggcccagcctgggagtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattattgtgcccttgattacta

SEQ ID NO: 457586 - DNA, 484 bp, Homo sapiens; identical to SEQ ID NO: 448254
  misc_feature: HEFZJCU01AEPLH.12.75.G09.1.454.heavy.3.raw

SEQ ID NO: 457587 - DNA, 507 bp, Homo sapiens
  misc_feature: HEFZJCU01BY5C2.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtaatgtagtggtgactgcttgtttggagcttttgactactggggccagggaaccctggtcatcgtctcctcagcctccaccaagggcccatcggtcttcccctggcaccctcctccaagagcacctctgggggcacagcggccctgggctgcctggtcaaggactacttccgagtagtaca

SEQ ID NO: 457588 - DNA, 527 bp, Homo sapiens
  misc_feature: HEFZJCU01CKNEK.9.30.C08.1.454.heavy.3.raw
tgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccagcccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaagcagcgcctactatactttaaactttgactttctggggccagggatcccgtggttccaccgtctcctcagccta

SEQ ID NO: 457589 - DNA, 507 bp, Homo sapiens
  misc_feature: HEFZJCU01B9CPC.4.81.H04.1.454.heavy.3.raw
agcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctggggggtccctgagactctcgtgtgtagtctctgaattcatcttcagggactttgacatgaattgggtccgccaggctccagggaaggggctggagtgggtctcatccatcagttccagtactcgttacatatactacgcagactcagtgaggggccgattcaccatctccagagacaacgccaagaactcagtgtttctgcaaatgaacagcctgagagtcgaggactcggctgtctactactgtgcgaggaataagggagactaccctacgatttggacac

SEQ ID NO: 457590 - DNA, 500 bp, Homo sapiens
  misc_feature: HEFZJCU01C3295.10.71.G05.1.454.heavy.3.raw
catagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacggggtgtttattactgtgggagaaatcctagtggcatcacctggt

SEQ ID NO: 457591 - DNA, 503 bp, Homo sapiens
  misc_feature: HEFZJCU01EDJJP.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaaggggactgacatctgacgacacggccatgtattattgtgcgagagaaatgttaggtactgctttggtcctggggcccggaaccgggtc

SEQ ID NO: 457592 - DNA, 506 bp, Homo sapiens
  misc_feature: HEFZJCU01CFWAV.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttccccctggccgcctgctccaggagcacctccgagagcacagcggccctgggctgcctggtcaggactacttcctatgtatact

SEQ ID NO: 457593 - DNA, 523 bp, Homo sapiens
  misc_feature: HEFZJCU01DGUSK.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggagtcacagagactctcctgtgcagcctctgggttcaccttcagtagctacggcatgcactgggtccgccaaactccaggcaagggattggagtgggtggcagttgttcatctgagggcagtgttcaatggtatgctgacgccgtgaagggccgattcaccatctccagagacaactccaggaacacaatgtatttggacctgaacagcctaagtcctgaggacacgggtgtatactactgtacgaaggaggggggaaccagcgggagttccgaagtactcctttgacgtcgtc

SEQ ID NO: 457594 - DNA, 508 bp, Homo sapiens
  misc_feature: HEFZJCU01D6DHK.52.24.C02.1.454.heavy.3.raw
cgcagtacgacacgaccggtgctcgatttagtacagatcgttagggaaaggggagctctgagagaggagccttagccctggattccaaggcctatccacttggtgatcagcactgagcaccgaggattcaccatggaattggggctccgctgggttttccttgttgctattttagaaggtgtccagtgtgaggtgcagctggtggagtctgggggaggcctggtcaagccgggggggtccctgagactctcctgtgcagcctctggattcaccttcagcagttatagcatgaactgggtccgccaggctccagggaaggggctggagtgggtctcatttattagtactagttacttatactacgcagactcagtgaagggccgattcaccatctccagagacaacgccaggaattcactatatttgcaaatgaacagcctgcgagccggaggacacggctgtgtattactgtgcgcgagaacacagcaatggccatttcgactacgtc

SEQ ID NO: 457595 - DNA, 469 bp, Homo sapiens; identical to SEQ ID NO: 445536
  misc_feature: HEFZJCU01A98C7.48.51.E07.1.454.heavy.3.raw

SEQ ID NO: 457596 - DNA, 517 bp, Homo sapiens
  misc_feature: HEFZJCU01CGSV1.10.53.E09.1.454.heavy.3.raw
catagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaatgaacagcctgagagctgaggacacggctgtgtattactgttcgtttggttctgactcgtcgggggataccttcagcacgtcggggcgac

SEQ ID NO: 457597 - DNA, 497 bp, Homo sapiens
  misc_feature: HEFZJCU01EC0RV.13.37.D04.1.454.heavy.3.raw
tcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatccactgtgcgaaagatattgtaatga

SEQ ID NO: 457598 - DNA, 501 bp, Homo sapiens
  misc_feature: HEFZJCU01AHO0E.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagcctttggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaaggggac

SEQ ID NO: 457599 - DNA, 539 bp, Homo sapiens
  misc_feature: HEFZJCU01C6E6G.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtcttcccctggcgccctgctccaggagcacctcccggagacgcaacgacggcccggtccggtcgggtcgcgtccgtcggtacgaacgtaccgttacctaccggagtcggtcgtctcgt

SEQ ID NO: 457600 - DNA, 504 bp, Homo sapiens
  misc_feature: HEFZJCU01EQUVW.10.23.C01.1.454.heavy.3.raw
catagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcagctttgatgaatatgccatggactgggtccggcaagttccagggaagggcctggagtgggtctcaggtattgattggaatagtgggtaccattgcctatgcggactctgtgaagggccgattcaccatcaccagagacgacgccaggagctccctgtatctccaaatgaacagtctgagacctgaggacacggccttgtattactgtgtaagagggagtcagggtttctaac

SEQ ID NO: 457601 - DNA, 504 bp, Homo sapiens
  misc_feature: HEFZJCU01CPB3R.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggtcctttgacttctc

SEQ ID NO: 457602 - DNA, 514 bp, Homo sapiens
  misc_feature: HEFZJCU01EC6IY.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatgtccttttgaccagtggggccagggaaccctggtcaccgtctcctcagcttccaccaagggcccatcggtcttcccctggcgccctgctccaggagcacctctgggggcacagcggcccg

SEQ ID NO: 457603 - DNA, 492 bp, Homo sapiens; identical to SEQ ID NO: 445919
  misc_feature: HEFZJCU01C2DRQ.14.25.C03.1.454.heavy.3.raw

SEQ ID NO: 457604 - DNA, 503 bp, Homo sapiens
  misc_feature: HEFZJCU01EXP45.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactccgtgaggggccgattcagcatctccagagacaacggcaagagtatactgtatctaggaaatgaacaatctgagagtcgacgatacggctgtctatcattgttgttttcgatgccttcggtccgcgggtacttcgtggggcc

SEQ ID NO: 457605 - DNA, 518 bp, Homo sapiens; identical to SEQ ID NO: 444718
  misc_feature: HEFZJCU01CAZ1S.9.34.D01.1.454.heavy.3.raw

SEQ ID NO: 457606 - DNA, 522 bp, Homo sapiens
  misc_feature: HEFZJCU01EK5M5.13.76.G10.1.454.heavy.3.raw
tcacgtactacacgaccggtgctcgatttagtcactcatacagggggcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtcgtggggccaagggaccacggtctaccg

SEQ ID NO: 457607 - DNA, 501 bp, Homo sapiens
  misc_feature: HEFZJCU01DRSSQ.9.30.C08.1.454.heavy.3.raw
tgatacgtctcacgaccggtgctcgatttagtctgacgtcaaagggaaagggtctgtgaagccttcacagaccctgtccctcacctgcactgtctctggtgactccatcaccggtactaattactactggagttggatccgccagccccccgggaagggcctggagtggattggatacgcctttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccagggatccctggtcaccgtctcctcagcctccaccaagggcccatcggtcttcccctggcgccctgctccaggagcacctccgagagcacagcggccctgggctgcctggtcaaggactacttccagacgtatca

SEQ ID NO: 457608 - DNA, 516 bp, Homo sapiens; identical to SEQ ID NO: 451892
  misc_feature: HEFZJCU01ECFTS.8.33.C11.1.454.heavy.3.raw

SEQ ID NO: 457609 - DNA, 510 bp, Homo sapiens; identical to SEQ ID NO: 447226
  misc_feature: HEFZJCU01BZKCQ.12.78.H01.1.454.heavy.3.raw

SEQ ID NO: 457610 - DNA, 521 bp, Homo sapiens
  misc_feature: HEFZJCU01CU35N.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaagggaggggggaaccaggcgggaggttccaagtacttccg

SEQ ID NO: 457611 - DNA, 507 bp, Homo sapiens
  misc_feature: HEFZJCU01C68DC.10.23.C01.1.454.heavy.3.raw
catagtagtgcacgaccggtgctcgatttagtacacgtgattagggattgggggggagaggagccccagccctgagattcccaggtgtttccattcagtgatcagcactgaacacagaggactcaccatggagttgggactgagctggattttccttttggctattttaaaaggtgttcagtgtgaagtgcagctggtggagtctgggggaggcttggtacagcctggcaggtccctgagactctcctgtgcagcctctggattcagctttgatgaatatgccatggactgggtccggcaagttccagggaagggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagagggagtcgagggtttcaactattatagtt

SEQ ID NO: 457612 - DNA, 496 bp, Homo sapiens
  misc_feature: HEFZJCU01ELP12.52.85.H08.1.454.heavy.3.raw
cgcagtacgacacgaccggtgctcgatttagtatcactcagtcgcggggtatcactcagtcgcggggatactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctgatgcctccatcagtcgtgacgattactactggagctggatccgccagcccccagggaagggcctggaatggattggctacatcttttacagtgagagcacctcctacaacccgtccctcaagagtcgagttaccatatcagctgacaagtccaagaaccacttctccctgaagctgacctctgtgactgccacagacacggccgtctattactgtgccagagggatcgctagaggtggctccatcgttttagacttccg

SEQ ID NO: 457613 - DNA, 482 bp, Homo sapiens; identical to SEQ ID NO: 444503
  misc_feature: HEFZJCU01CUGVE.7.10.A10.1.454.heavy.3.raw

SEQ ID NO: 457614 - DNA, 504 bp, Homo sapiens; identical to SEQ ID NO: 453470
  misc_feature: HEFZJCU01A7015.4.58.F03.1.454.heavy.3.raw

SEQ ID NO: 457615 - DNA, 523 bp, Homo sapiens; identical to SEQ ID NO: 446270
  misc_feature: HEFZJCU01ETI1K.12.40.D07.1.454.heavy.3.raw

SEQ ID NO: 457616 - DNA, 491 bp, Homo sapiens; identical to SEQ ID NO: 444749
  misc_feature: HEFZJCU01DGJKW.11.13.B02.1.454.heavy.3.raw

SEQ ID NO: 457617 - DNA, 471 bp, Homo sapiens
  misc_feature: HEFZJCU01DF33T.49.9.A09.1.454.heavy.3.raw
agtcgagagacacgaccggtgctcgatttagcgagacgcgcaggggtccgggagatcatgagggtgtccttgggttttggggggaagaggaagactgacggtccccccaggagttcaggtgctgggcacggtgggcattggtgactcatgtggaagacagaaaattgtacgcagactccgtgaggggccgattcatcatctccaaagactactccaagaatacggtgtatcttcaaatgaatggcctcgtttttgcggacacggctgtttattattgtgcgacagggggcccccctttccaggagcgatcatactactttgaccactggggccagggaaccctggtcaccgtctcctcagcctccaccaagggcccatcggtcttccccctcggcaccctcctcccaagagcacctctgggggcacagcggccctgggctgcctggtcaaggactacttcctctctcgact

SEQ ID NO: 457618 - DNA, 390 bp, Homo sapiens; identical to SEQ ID NO: 444654
  misc_feature: HEFZJCU01C7NN1.16.17.B06.1.454.heavy.3.raw

SEQ ID NO: 457619 - DNA, 527 bp, Homo sapiens
  misc_feature: HEFZJCU01EFZ6P.12.40.D07.1.454.heavy.3.raw
atacgacgtacacgaccggtgctcgatttagtgatagagcgtaacaacaggggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctcccagcctccaccaagggcccatcggtcttcccctggccgcctgcc

SEQ ID NO: 457620 - DNA, 481 bp, Homo sapiens; identical to SEQ ID NO: 445517
  misc_feature: HEFZJCU01BDTE5.22.36.D03.1.454.heavy.3.raw

SEQ ID NO: 457621 - DNA, 512 bp, Homo sapiens
  misc_feature: HEFZJCU01EWE94.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatggtggtgcaaagatggtcgttgtttgttttggccggtgaactactggggccagggcaccctggtcaccgtctcctcagcttccaccaagggcccatcggtcttccccctggcgccctgctccaggagcacctctgggggcacagcggccctgggctgcctgtcaaggactactcccatac

SEQ ID NO: 457622 - DNA, 490 bp, Homo sapiens
  misc_feature: HEFZJCU01D4LIA.47.85.H08.1.454.heavy.3.raw
  modified_base (448)..(448): a, c, t, g, unknown or other
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagaacgcaacngccgccgtggctcgccgtggtacgaagacctacttcctacgt

SEQ ID NO: 457623 - DNA, 502 bp, Homo sapiens
  misc_feature: HEFZJCU01AJO3W.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaactgtatcttcaaataaacagtctgagacttgaggacacggctgtctattactgtgcgagagactacggtgaccttttctggtatttcgatctctggggccgtggcacctggtcactgtctcctcggccttccaccaagggcccatcggtcttcccctggccgccctgctccaggagcacctctggggc

SEQ ID NO: 457624 - DNA, 409 bp, Homo sapiens; identical to SEQ ID NO: 444519
  misc_feature: HEFZJCU01DTLPB.3.41.D08.1.454.heavy.3.raw

SEQ ID NO: 457625 - DNA, 403 bp, Homo sapiens; identical to SEQ ID NO: 444540
  misc_feature: HEFZJCU01ESAFA.16.72.G06.1.454.heavy.3.raw

SEQ ID NO: 457626 - DNA, 516 bp, Homo sapiens
  misc_feature: HEFZJCU01C4CGK.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttccccctggcaccctcctccaagagcacctctgggggcacagcggcctgggctgcctggtcaagactacttccagacgtatca

SEQ ID NO: 457627 - DNA, 537 bp, Homo sapiens
  misc_feature: HEFZJCU01DZN76.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccggggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggagggccgtttcatgtctggggccaagggacgctggtcaccgtctcttcagcctccaccaagggcccatcggtcttcccctggcaccctcctccagagcacctctgggggcacagcc

SEQ ID NO: 457628 - DNA, 515 bp, Homo sapiens
  misc_feature: HEFZJCU01CQ4AJ.49.35.D02.1.454.heavy.3.raw
agtcgagagacacgaccggtgctcgattagcacacgatagttgggtttgggggaggcgtggtccagcctgggaggtccctgagactctcctgtgcagcctctggattcgtcgtctagtgtctaccctatcgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggccccatccggtctttcccccttggccaccctcctccaacgagcacctctgggggcacagcggccctgggctgcctggtcaaggactacttcctctctcga

SEQ ID NO: 457629 - DNA, 423 bp, Homo sapiens; identical to SEQ ID NO: 446550
  misc_feature: HEFZJCU01AWTL0.11.22.B11.1.454.heavy.3.raw

SEQ ID NO: 457630 - DNA, 501 bp, Homo sapiens
  misc_feature: HEFZJCU01A4OYK.51.59.F04.1.454.heavy.3.raw
cgatcgtatacacgaccggtgctcgatttagtacacacacttagggattgggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcag

SEQ ID NO: 457631 - DNA, 483 bp, Homo sapiens
  misc_feature: HEFZJCU01E0QE4.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttccccctggcaccctcctccaagagcacctctgggggcacagcggccctgggctgcctggtcaaggactactccgtatctctcg

SEQ ID NO: 457632 - DNA, 477 bp, Homo sapiens
  misc_feature: HEFZJCU01B5W7N.48.71.G05.1.454.heavy.3.raw
agtatacatacacgaccggtgctcgatttagtgtcgtcgcaagagagagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtatagcaaactacgcacagaagttccagggcagagtcacgattaccgcggacaaatccacgagcacagcctacatggagctgagcagcctgagatctgaggacacggccgtgtattactgtgcgagagatcagagtggttt

SEQ ID NO: 457633 - DNA, 500 bp, Homo sapiens
  misc_feature: HEFZJCU01C3I49.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 457634 - DNA, 396 bp, Homo sapiens; identical to SEQ ID NO: 444469
  misc_feature: HEFZJCU01BBPHG.47.46.E02.1.454.heavy.3.raw

SEQ ID NO: 457635 - DNA, 488 bp, Homo sapiens
  misc_feature: HEFZJCU01DW1R9.11.13.B02.1.454.heavy.3.raw
cgagagataccacgaccggtgctcgatttagtctagcgactttgggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccgagggcccatcggtcttcccctgcgccctgctccaggagcacctccgagagcacagcggccctgggctgcctggtcaggactactccgtatctctcg

SEQ ID NO: 457636 - DNA, 396 bp, Homo sapiens; identical to SEQ ID NO: 444469
  misc_feature: HEFZJCU01B5QC4.47.46.E02.1.454.heavy.3.raw

SEQ ID NO: 457637 - DNA, 542 bp, Homo sapiens
  misc_feature: HEFZJCU01D76D7.16.39.D06.1.454.heavy.3.raw
tgtactactccacgaccggtgctcgatttagtgacatctcgcagttctttgggttttggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccgggggggtccctgagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccgaattcaccatctccagagacaattccaagaacacggtgaatcttcaaatgaacagcctgagaaccgaggacacggccgtatattattgtataggttatggtggtattcgggccctggggccagggaaccgtggtcaccgtctcctcagcctccaccg

SEQ ID NO: 457638 - DNA, 527 bp, Homo sapiens; identical to SEQ ID NO: 446200
  misc_feature: HEFZJCU01CFREB.7.70.G04.1.454.heavy.3.raw

SEQ ID NO: 457639 - DNA, 526 bp, Homo sapiens; identical to SEQ ID NO: 447476
  misc_feature: HEFZJCU01A5N7Z.14.55.E11.1.454.heavy.3.raw

SEQ ID NO: 457640 - DNA, 552 bp, Homo sapiens
  misc_feature: HEFZJCU01D4UAP.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaactgaccgctgtgaccgccgcggacacggctgtgtattactgtgcgagacgaatgggcgggtggctacgacttgactttttggggccgaggggaaaccgtggtaccgacccgtccttcccccacgccgtttcccacccaacggggaccccaactccggtcctttccccccg

SEQ ID NO: 457641 - DNA, 509 bp, Homo sapiens; identical to SEQ ID NO: 450407
  misc_feature: HEFZJCU01EVG3J.13.39.D06.1.454.heavy.3.raw

SEQ ID NO: 457642 - DNA, 514 bp, Homo sapiens
  misc_feature: HEFZJCU01C6OKC.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcagtcgacactttgattactggggccgggaaccctggtcgccgtctcctcagcctccaccaagggcccatcggtcttccccctggcaccctcctccaagagcacctctggggcacagcggccctggctgcctgtcaaggactactccagtacgtatca

SEQ ID NO: 457643 - DNA, 490 bp, Homo sapiens; identical to SEQ ID NO: 456369
  misc_feature: HEFZJCU01BZXTP.48.20.B09.1.454.heavy.3.raw

SEQ ID NO: 457644 - DNA, 519 bp, Homo sapiens
  misc_feature: HEFZJCU01CWEQV.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaatacgattttcgatccctccgcagtcgacactttgattactggggccgggaaccctggtcgccgtctcctcagcctccaccaagggcccatcggtcttcccctggcgccctgctccaggagcacctccgagagcacagccggccctgggctgcctggtcaaggactacttccagacgtatctac

SEQ ID NO: 457645 - DNA, 508 bp, Homo sapiens
  misc_feature: HEFZJCU01DKAMJ.48.81.H04.1.454.heavy.3.raw
agtatacatacacgaccggtgctcgatttagtagtgtagattcgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggagttatcatctactactttgaa

SEQ ID NO: 457646 - DNA, 524 bp, Homo sapiens
  misc_feature: HEFZJCU01EGLB1.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcgagggaactctggtcaccgtctcctcagcctccaccaagggcccatcggtccttcccctggccgccctgcctccgaggacgcaccctccgacgagcacagccggccctgggctcg

SEQ ID NO: 457647 - DNA, 379 bp, Homo sapiens; identical to SEQ ID NO: 444450
  misc_feature: HEFZJCU01C97DM.47.77.G11.1.454.heavy.3.raw

SEQ ID NO: 457648 - DNA, 500 bp, Homo sapiens
  misc_feature: HEFZJCU01AX1VN.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtgggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttc

SEQ ID NO: 457649 - DNA, 518 bp, Homo sapiens
  misc_feature: HEFZJCU01EECH3.10.53.E09.1.454.heavy.3.raw
catagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaatacctttcagcactggggccgac

SEQ ID NO: 457650 - DNA, 487 bp, Homo sapiens; identical to SEQ ID NO: 450070
  misc_feature: HEFZJCU01C1C8Z.47.55.E11.1.454.heavy.3.raw

SEQ ID NO: 457651 - DNA, 509 bp, Homo sapiens; identical to SEQ ID NO: 447939
  misc_feature: HEFZJCU01B6SQ7.17.25.C03.1.454.heavy.3.raw

SEQ ID NO: 457652 - DNA, 529 bp, Homo sapiens
  misc_feature: HEFZJCU01DZZXB.16.87.H10.1.454.heavy.3.raw
  modified_base (483)..(483): a, c, t, g, unknown or other
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaagggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtatactgtgcaaggcagttcgtgaaacngttatgggttggggggagtttggggtttttttcgttacgtacgggt

SEQ ID NO: 457653 - DNA, 539 bp, Homo sapiens
  misc_feature: HEFZJCU01EL1ZM.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaacgggcccatcggtcttcccctggcgccctgcctccacggagcaccctccgacgagccacacgccggccccgtcggggccg

SEQ ID NO: 457654 - DNA, 491 bp, Homo sapiens; identical to SEQ ID NO: 446104
  misc_feature: HEFZJCU01AX69F.3.34.D01.1.454.heavy.3.raw

SEQ ID NO: 457655 - DNA, 519 bp, Homo sapiens
  misc_feature: HEFZJCU01CYY3Z.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgttcatctgagggcagtgttcaatggtatgcagactccgtgaagggccgattcaccatctccagagacaattccaggaacacaatgtatttggaaatgaacagcctaagtcctgaggacacgggtgtatactactgtacgaagggaggggggaaccaggcgggagttccaagtacttccg

SEQ ID NO: 457656 - DNA, 396 bp, Homo sapiens; identical to SEQ ID NO: 444469
  misc_feature: HEFZJCU01D70TW.47.46.E02.1.454.heavy.3.raw

SEQ ID NO: 457657 - DNA, 542 bp, Homo sapiens
  misc_feature: HEFZJCU01D9LES.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatcccctgaaagcgtcaactactactactacggtatggacctctcggggccaagggaccg

SEQ ID NO: 457658 - DNA, 504 bp, Homo sapiens
  misc_feature: HEFZJCU01E1XNN.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatactgagagtcgacgatacggctgtctatcattgtgttttcgatgccttcggtccgcgggactctgggccac

SEQ ID NO: 457659 - DNA, 514 bp, Homo sapiens
  misc_feature: HEFZJCU01AG9RQ.12.27.C05.1.454.heavy.3.raw
atacgacgtacacgaccggtgctcgatttagacgcgatcgaagggtttggggtctgagagaggagcccagccctgggattttcaggtgttttcatttggtgatcaggactgaacagagagaactcaccatggagtttgggctgagcgtgcgtttctagtcggctatttaaaaggtgtcagtgtgaggtgcaactggtggagtctgggggaggcttggtacagccgggggggtccctgagactctcctgtgcaggctctggattcatctttaacaactatgccatgagctgggtccgccaggctccagggaaggggctggagtgggtctcagctattagtaatagtggtgatagcacatcctacgcagactccgtgaagggccgcttcaccatctccagagacaattccaagaacacgctgtatctccaaatgaacagtctcagagccgaggacacgggcccatatattactgttgcgaaagacaacagccgcatttgggggagtcatcgtcctt

SEQ ID NO: 457660 - DNA, 513 bp, Homo sapiens; identical to SEQ ID NO: 445134
  misc_feature: HEFZJCU01DTIA6.3.34.D01.1.454.heavy.3.raw

SEQ ID NO: 457661 - DNA, 513 bp, Homo sapiens
  misc_feature: HEFZJCU01A15QO.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaaagttattggatgacctgggtccgccaggctccagggaaggggctggagtgggtggccaacataaacaaagacggaagtcagaaaaactatgtggactctgtgaacggccgattcaccatctccagagacaacgccaagaattcactgtatttgcaaatgaacagcctgagaggcgaggacacggccgtgtattattgtgcgcgagatgatagtagactctacagtagcaggtggta

SEQ ID NO: 457662 - DNA, 507 bp, Homo sapiens
  misc_feature: HEFZJCU01D17QR.52.71.G05.1.454.heavy.3.raw
cgcagtacgacacgaccggtgctcgatttagtgtcgtcgcaagagagagggggagctctgagagaggagcccagccctgggattttcaggtgttttcatttggtgatcaggactgaacagagagaaatcaccatggagtttgggctgagctggctttttcttgtggctattttaaaggtggccaatgtgaggtgcagctggtggagtctgggggaggcttggtacagcccggggggtccctgagactctcctgtgcagcctctggattcagttttaccagctatgccatggcctgggtccgccaggctccagggaagggctaggagtgggtctcaggtattagtggtagtgctatgaccacattctacgcagactccgtgaagggccggttcaccatttccagagacaattccaagagtaccctgtatctgcaaatgaacagcctgagagccgacgacacggccgtatattactgtgcgaagcaattactctatggacattatcggg

SEQ ID NO: 457663 - DNA, 503 bp, Homo sapiens
  misc_feature: HEFZJCU01B08T6.10.71.G05.1.454.heavy.3.raw
  modified_base (450)..(450): a, c, t, g, unknown or other
catagtagtgcacgaccggtgctcgatttagtgtcgtcgcaagagagagggggtctgggagaggagcccagcactagaagtcggcggtgcctccattcggtgatcagcactgaacacagaggactcaccatggagtttgggctgagcgtgggttttccgtcgttagctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagngccgaggacacgggtgtttattactgtgggagaaatcctagtggcatctaccg

SEQ ID NO: 457664 - DNA, 531 bp, Homo sapiens
  misc_feature: HEFZJCU01BOR3F.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtgaattgactactgggccagggaaccctggtcaccgtctcctcagcctccaccaaggg

SEQ ID NO: 457665 - DNA, 526 bp, Homo sapiens
  misc_feature: HEFZJCU01CDS3X.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccgagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctggggccgtc

SEQ ID NO: 457666 - DNA, 508 bp, Homo sapiens
  misc_feature: HEFZJCU01EK34A.48.44.D11.1.454.heavy.3.raw
agtatacatacacgaccggtgctcgatttagcgcagtacgaaggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttccccctggcgccctgctccaggagcacctcccgagagcacagcggccctgggctgcctggtcaggactacttcctatgtatact

SEQ ID NO: 457667 - DNA, 504 bp, Homo sapiens; identical to SEQ ID NO: 446177
  misc_feature: HEFZJCU01BRKDF.15.55.E11.1.454.heavy.3.raw

SEQ ID NO: 457668 - DNA, 499 bp, Homo sapiens
  misc_feature: HEFZJCU01BQMQ5.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacggggtgtttattactgtgggagaaatcctaagtggcta

SEQ ID NO: 457669 - DNA, 397 bp, Homo sapiens
  misc_feature: HEFZJCU01ALHHM.47.72.G06.1.454.heavy.3.raw
agctcacgtacacgaccggtgctcgatttagctacgactgcaagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 457670 - DNA, 379 bp, Homo sapiens; identical to SEQ ID NO: 444450
  misc_feature: HEFZJCU01DNE4Y.47.77.G11.1.454.heavy.3.raw

SEQ ID NO: 457671 - DNA, 501 bp, Homo sapiens; identical to SEQ ID NO: 445027
  misc_feature: HEFZJCU01E05GA.26.23.C01.1.454.heavy.3.raw

SEQ ID NO: 457672 - DNA, 398 bp, Homo sapiens; identical to SEQ ID NO: 444524
  misc_feature: HEFZJCU01B4BW4.7.60.F05.1.454.heavy.3.raw

SEQ ID NO: 457673 - DNA, 525 bp, Homo sapiens
  misc_feature: HEFZJCU01CP59M.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctggagactctcctgtgcagcctctgggttcaccgtcagtcacacctacatgagttgggtccgccaggctccagggaaggggctggagtggggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccagaacgttactacgctatgacgtctggggccaaggaccac

SEQ ID NO: 457674 - DNA, 486 bp, Homo sapiens
  misc_feature: HEFZJCU01DERA1.53.50.E06.1.454.heavy.3.raw
cgcgtatacacacgaccggtgctcgatttagatctactgacaacacacaaggggtctgggagaggagcccagcactagaagtcggcggtgtttccattcggtgatcagcactgaacacagaggactcaccatggagtttgggctgagctgggtcttcctcgttgctcttttaagaggtgtccagtgccaggtgcagttggtggagtctgggggaggcgtggtccagcctgggcggtccctgagactctcctgtgcagcctctggattcaccttcagagtctatggcatgaactgggtccgccaggctccaggcaaggggctggagtgggtggcacttatactagatgatggaagtaataaatattatgcagactccgtgaagggccgattcaccatctccagagacaattccaagaacactctgtatctgcaaatgaacagcctgagacctgaggacacggctgtctactactgtgacgaaacggt

SEQ ID NO: 457675 - DNA, 382 bp, Homo sapiens
  misc_feature: HEFZJCU01DZNN0.22.46.E02.1.454.heavy.3.raw
acatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaatgaacagcctgacagccgaggacacggctgtctattactgtacgagagattggcaagcctgggcctttgatgtctggggccctgggacaatggtcaccgtctctttagcctccaccaagggcccatcggtcttccccctggcgccctgctccaggagcacctccgagagcacagcggccctgggctgcctggtcaaggactacttccacgcgtatgt

SEQ ID NO: 457676 - DNA, 517 bp, Homo sapiens
  misc_feature: HEFZJCU01CI30O.12.71.G05.1.454.heavy.3.raw
  modified_base (470)..(470): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgaggagggccagctgctgggagcgtctacatatttcgacccctggggtccagggaacccgaaggtcaccgtctcctcagcctccaccaagggcccatccgtcttccccctggcgccctcgctccaggngcacctccgagagcacagcggccctggctgctgtcagactactctcg

SEQ ID NO: 457677 - DNA, 498 bp, Homo sapiens
  misc_feature: HEFZJCU01BYQKJ.53.25.C03.1.454.heavy.3.raw
cgcgtatacacacgaccggtgctcgatttagtagtgtagatttgggtttgggggggtccctgagactctcctgtgcagcctctggattcaccttcagtatttatagcatgaattggatccgccaggctccagggaaggggctcgagtgggtctcatccattagtagtagtagtagttacaaatactacgcagactcagtgaagggccgattcaccgtctccagagacaacgccaagaactcactgtatctgcaaatgaatagcctgagagccgaggacacggctgtatatttctgtgcgagagatgacccatataacagtgactactactctgtggatgatgcttttgatgtctggggccaagggacaatagtcaccgtctcttcagcctccaccaagggcccatcggtcttccccctggccaccctccctccaagagcacctctgggggcacagcggccctgggctgcctggtcaaggactacttcctcgtactgcg

SEQ ID NO: 457678 - DNA, 508 bp, Homo sapiens
  misc_feature: HEFZJCU01BEMGP.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctggggcacagcggccctgggctgcctggtcaaggactacttcctacgtcgtat

SEQ ID NO: 457679 - DNA, 514 bp, Homo sapiens
  misc_feature: HEFZJCU01CK20A.13.36.D03.1.454.heavy.3.raw
tcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcggagaccctgtccctcacgtgcgctgtctctggtgggttcttcagtggttactactggagctggatccgccagtccccagggaaggggctggagtggattggggaaatcaatcatagtggaagcaccaactacaacccgtccctcgagagccgagtcaccatgtcagtagacacgtccaagaaccagttctccctgagggtgagctctgtgaccgccgcggacacggctgtgtacttctgtgcgagaggcaatttttggactcgtcattctccctttgacttctggggccagggaaccctagtcaccgtcc

SEQ ID NO: 457680 - DNA, 503 bp, Homo sapiens
  misc_feature: HEFZJCU01A9CYO.9.81.H04.1.454.heavy.3.raw
tgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtctgggggaggcttggtgcagcctggcacctccctgagactctcctgtgccgcctctggattcatgtttgatgattatgccatgcactgggtccggcaagttccagggaagggcctggagtgggtctcaggtattacttggagtagcactaccacaggctatgcggactctgtgaggggccgattcaccatctccagagacaacgccaagaactccctatatctgcaaatgaatggtctgagagttgaggacacggccttgtattactgtgcaaaagatggaaaccccaggtaggacgc

SEQ ID NO: 457681 - DNA, 498 bp, Homo sapiens; identical to SEQ ID NO: 445952
  misc_feature: HEFZJCU01BNQZH.11.71.G05.1.454.heavy.3.raw

SEQ ID NO: 457682 - DNA, 504 bp, Homo sapiens
  misc_feature: HEFZJCU01BRB36.40.81.H04.1.454.heavy.3.raw
tctagcgactcacgaccggtgctcgatttagtagtgtagattcgcggggcagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccagggaaccctggtcc

SEQ ID NO: 457683 - DNA, 503 bp, Homo sapiens; identical to SEQ ID NO: 445995
  misc_feature: HEFZJCU01DLGF1.17.25.C03.1.454.heavy.3.raw

SEQ ID NO: 457684 - DNA, 491 bp, Homo sapiens; identical to SEQ ID NO: 446104
  misc_feature: HEFZJCU01CT154.3.34.D01.1.454.heavy.3.raw

SEQ ID NO: 457685 - DNA, 486 bp, Homo sapiens; identical to SEQ ID NO: 448390
  misc_feature: HEFZJCU01EUU04.10.85.H08.1.454.heavy.3.raw

SEQ ID NO: 457686 - DNA, 509 bp, Homo sapiens; identical to SEQ ID NO: 450407
  misc_feature: HEFZJCU01EQB9N.13.39.D06.1.454.heavy.3.raw

SEQ ID NO: 457687 - DNA, 420 bp, Homo sapiens
  misc_feature: HEFZJCU01EY30L.48.14.B03.1.454.heavy.3.raw
agtatacatacacgaccggtgctcgatttagtgtgagtagttccgcgggcacgaccggtgctcgatttagtgtgagtagtttgggtttgggcaacggtaacacaaactatgcacagaagctccagggcagagtcaccatgaccacagacacatccacgagcacagcctacatggagctgaggagcctgagatctgacgacacggccgtgtattactgtgcgagagaagggttttactatggttcggggagtctccgacccagcaactggttcgacccctggggccagggaaccctggtcaccgtctcctcagcctccaccaagggcccatcggtcttcccctggcaccctcctccaagagcacctctgggggcacagcggccctgggctgcctggtcaaggactacttcctatgtatact

SEQ ID NO: 457688 - DNA, 498 bp, Homo sapiens
  misc_feature: HEFZJCU01BX6HM.47.56.F01.1.454.heavy.3.raw
agctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgctattttaaaaggtgtccagtgtgaggtgcaactggtggagtccgggggaggcttaattcagcctggggggtccctgagactctcctgtgcagcctctggattcaccttcagtagttactggatgcactgggtccgccaagctccagggaagggactggtgtgggtctcacgtattaatcctgatggaagtcgcacaaactacgcggactccgtgagggaccgattcaccatctccagagacaacgccaagaacacgctgtatctgcaaatgcacagtctgagagccgacgatgcggctgtatatttctgtgcaagagatcaactggtggaccgactttatttc

SEQ ID NO: 457689 - DNA, 483 bp, Homo sapiens
  misc_feature: HEFZJCU01C0MPF.47.59.F04.1.454.heavy.3.raw
  modified_base (423)..(423): a, c, t, g, unknown or other
agctcacgtacacgaccggtgctcgatttagtacacacacttagggattggggggtccctgagactctcctgtgcagcctctggattcattttcagtagctacagcatgaattgggtccgccgggctccagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatccggtcttccccctggcgccctgctccaggngcacctctgggggcacagcggcctgggctgcctggtcaaggactacttcctacgtgagct

SEQ ID NO: 457690 - DNA, 527 bp, Homo sapiens
  misc_feature: HEFZJCU01DMO1T.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatccctgaaagcgtcaactactactactacggtatggacctc

SEQ ID NO: 457691 - DNA, 500 bp, Homo sapiens
  misc_feature: HEFZJCU01AF0P6.3.39.D06.1.454.heavy.3.raw
agacgcactccacgaccggtgctcgatttagtgacatctcgcagttctttgggttttggggagaggagcccagcactgggattccgaggtgtttccattcggtgatcagcactgaacacagaggactcaccatggagttttggctgagctgggttttccttgttgctttttcaaaaggtgtccagtgtgaggtgcagatggtggagactggaggaggcttgatccagccgggggggtccctgagactctcatgtacaggctctgagttcagcgtcactaaatactacatgagctgggtccgccaggctccagggagggactggactgggtctccagtgttaacagcgatggaagtacatattatgcagactccgtgaagggccgattcaccatctccagagacaattccaagaacactctgtatcttcaaatgaacagcctgagagccgaggacacggccttctattactgtgcgagcgatcacgggcggagtctgatta

SEQ ID NO: 457692 - DNA, 523 bp, Homo sapiens
  misc_feature: HEFZJCU01A224G.18.78.H01.1.454.heavy.3.raw
tacgagtatgcacgaccggtgctcgatttagtgtgagtagtttgggtttggggctgggagaggagctccagccttgggattcccagctgtctccactcggtgatcggcactgaatacaggagactcaccatggagtttgggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaatgaataacctgagagccgaggacacggccatgtattactgtgtggggcatttacttgacccctgggggcccggggaacctggtcaccgtctccccta

SEQ ID NO: 457693 - DNA, 509 bp, Homo sapiens
  misc_feature: HEFZJCU01EXVV5.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagtcttttgatctcgtgggggccaagggacactggtcaccgtctcttcagcctccaccaagggcccatcggtctcccctggccgcctgctccaggacg

SEQ ID NO: 457694 - DNA, 520 bp, Homo sapiens
  misc_feature: HEFZJCU01CGJAE.10.53.E09.1.454.heavy.3.raw
catagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcgggggaataccttcagcactggggccagggcaccctggtcaccgtctcctcagcctccaccaagggcccatcggtcttcccctggccaccctcctccaagagcacctctgggggcacagcggcctgggctg

SEQ ID NO: 457695 - DNA, 430 bp, Homo sapiens
  misc_feature: HEFZJCU01BMTGO.11.39.D06.1.454.heavy.3.raw
cgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaagggcccatcggtcttccccctggcaccctcctccaagagcacctctgggggcacagcggccctgggctgcctggtcaaggaccttccgtatctctcg

SEQ ID NO: 457696 - DNA, 514 bp, Homo sapiens
  misc_feature: HEFZJCU01BFWJ9.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtattggaatgaacagcctaagtcctgaggacacgggtgtatactactgtacgaaggaggggggaaccgagcgggagttccaagtactc

SEQ ID NO: 457697 - DNA, 482 bp, Homo sapiens; identical to SEQ ID NO: 444503
  misc_feature: HEFZJCU01BV8NP.7.10.A10.1.454.heavy.3.raw

SEQ ID NO: 457698 - DNA, 491 bp, Homo sapiens; identical to SEQ ID NO: 445531
  misc_feature: HEFZJCU01CEDT6.11.38.D05.1.454.heavy.3.raw

SEQ ID NO: 457699 - DNA, 487 bp, Homo sapiens
  misc_feature: HEFZJCU01AD2U7.22.86.H09.1.454.heavy.3.raw
  modified_base (422)..(422): a, c, t, g, unknown or other
acatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttcnccaaatgaacagcctgagaggcgaggacacggcagtgtattactgtgcgagagatcgacatgacg

SEQ ID NO: 457700 - DNA, 519 bp, Homo sapiens
  misc_feature: HEFZJCU01D2248.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttggttctggggccaggggacctggtcatcgtctccccagcctccaccaggcccatcggtcttcccctggcg

SEQ ID NO: 457701 - DNA, 520 bp, Homo sapiens; identical to SEQ ID NO: 449320
  misc_feature: HEFZJCU01EN45N.12.58.F03.1.454.heavy.3.raw

SEQ ID NO: 457702 - DNA, 499 bp, Homo sapiens; identical to SEQ ID NO: 446805
  misc_feature: HEFZJCU01DUOWA.3.20.B09.1.454.heavy.3.raw

SEQ ID NO: 457703 - DNA, 516 bp, Homo sapiens
  misc_feature: HEFZJCU01BHN1V.48.82.H05.1.454.heavy.3.raw
agtatacatacacgaccggtgctcgatttagtcgagctctctcgcgggcacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgacttttggggccagggaaaccg

SEQ ID NO: 457704 - DNA, 511 bp, Homo sapiens
  misc_feature: HEFZJCU01CMEJH.16.9.A09.1.454.heavy.3.raw
tgtactactccacgaccggtgctcgatttagcgagacgcgcagggggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgacaaatgaacagcctggagagccgacgacacggccatatattactgtgcgaaagcaccggcagttagtcacccatactactttgactacgtc

SEQ ID NO: 457705 - DNA, 516 bp, Homo sapiens
  misc_feature: HEFZJCU01EHBG1.13.76.G10.1.454.heavy.3.raw
tcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtcgtggggccaac

SEQ ID NO: 457706 - DNA, 507 bp, Homo sapiens
  misc_feature: HEFZJCU01EOBGT.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggccgccctgctccaggagcacctccgagagcacagcggccctgggctgcctggtcaaggactacttcccactacta

SEQ ID NO: 457707 - DNA, 436 bp, Homo sapiens; identical to SEQ ID NO: 444686
  misc_feature: HEFZJCU01BNXRV.40.27.C05.1.454.heavy.3.raw

SEQ ID NO: 457708 - DNA, 520 bp, Homo sapiens
  misc_feature: HEFZJCU01CN6VO.13.87.H10.1.454.heavy.3.raw
tcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagatcccaaaccccttaccgtatttttgggagttggtttaacg

SEQ ID NO: 457709 - DNA, 517 bp, Homo sapiens
  misc_feature: HEFZJCU01CURYU.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggaggggggaaccgagcggggagttccaagtactcctttgtacg

SEQ ID NO: 457710 - DNA, 498 bp, Homo sapiens; identical to SEQ ID NO: 450312
  misc_feature: HEFZJCU01CCRDA.11.71.G05.1.454.heavy.3.raw
  modified_base (479)..(479): a, c, t, g, unknown or other

SEQ ID NO: 457711 - DNA, 523 bp, Homo sapiens
  misc_feature: HEFZJCU01CZQPU.49.67.G01.1.454.heavy.3.raw
agtcgagagacacgaccggtgctcgatttagagtatacatattgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttcccaggacagagtcaccattacccgagacacttccgcgaacacagcctacatggaactgagcggcctgagatttgaagacacggctgtgtattactgtgcgagagcaacggtcgtcatgggatttgactacgtggggccagggaaccccggtcaccggtctcctctcgcct

SEQ ID NO: 457712 - DNA, 396 bp, Homo sapiens; identical to SEQ ID NO: 444568
  misc_feature: HEFZJCU01EFBAF.47.46.E02.1.454.heavy.3.raw

SEQ ID NO: 457713 - DNA, 492 bp, Homo sapiens
  misc_feature: HEFZJCU01D3JMN.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctcccgagagcacagcggccctgggctgcctggtcaaggactacttccgtatctctcg

SEQ ID NO: 457714 - DNA, 500 bp, Homo sapiens
  misc_feature: HEFZJCU01DX0V9.17.10.A10.1.454.heavy.3.raw
cgtagactagcacgaccggtgctcgatttagcgtcgatctcagggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgataggctctatggactggacttctc

SEQ ID NO: 457715 - DNA, 528 bp, Homo sapiens; identical to SEQ ID NO: 452880
  misc_feature: HEFZJCU01D5H0Z.9.78.H01.1.454.heavy.3.raw

SEQ ID NO: 457716 - DNA, 483 bp, Homo sapiens; identical to SEQ ID NO: 453752
  misc_feature: HEFZJCU01EOIAT.19.53.E09.1.454.heavy.3.raw

SEQ ID NO: 457717 - DNA, 494 bp, Homo sapiens
  misc_feature: HEFZJCU01CU6GX.10.71.G05.1.454.heavy.3.raw
catagtagtgcacgaccggtgctcgatttagtgtcgtcgcaagagagaggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggcatcacctggtattgtgacttccggggccagggaaccgtggtcaccgtctcttcggcctccaccaagggcccatcggtcttcccctggcgccctgctccaggagcacctcccgagagcacagcggccctgggctgcctggtcaaggactacttcccactactatg

SEQ ID NO: 457718 - DNA, 504 bp, Homo sapiens
  misc_feature: HEFZJCU01CU03D.22.36.D03.1.454.heavy.3.raw
acatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctattttgggccgcggccgactac

SEQ ID NO: 457719 - DNA, 522 bp, Homo sapiens
  misc_feature: HEFZJCU01D2EI9.4.35.D02.1.454.heavy.3.raw
agcactgtagcacgaccggtgctcgatttagcacacgatagttgggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaagggaagggactggagtgggttggatatatctttcacaccgggaccaccaactacaatccctccctcaagagtcgactcaccatgtcactggacacttccaagaaccagttctccctaaaattgacctctgtgagcgctgcagacacggccgtctattactgtgcgagactgcggggctattatggttcgggagatcccagtggttttgatatatggggccaggggacagcggtcaccgtctcttcag

SEQ ID NO: 457720 - DNA, 466 bp, Homo sapiens; identical to SEQ ID NO: 445374
  misc_feature: HEFZJCU01C8XUD.16.78.H01.1.454.heavy.3.raw

SEQ ID NO: 457721 - DNA, 505 bp, Homo sapiens
  misc_feature: HEFZJCU01D2JSC.52.71.G05.1.454.heavy.3.raw
cgcagtacgacacgaccggtgctcgatttagtgtcgtcgcaagagagagggggagctctgagagaggagcccagccctgggattttcaggtgttttcatttggtgatcaggactgaacagagagaaatcaccatggagtttgggctgagctggctttttcttgtggctattttaaaaggtggccaatgtgaggtgcagctggtggagtctgggggaggcttggtacagcccggggggtccctgagactctcctgtgcagcctctggattcagttttaccagctatgccatggcctgggtccgccaggctccagggaaggggctggagtgggtctcaggtattagtggtagtgctatgaccacattctacgcagactccgtgaagggccggttcaccatttccagagacaattccaagagtaccctgtatctgcaaatgaacagcctgagagccgacgacacggccgtatattactgtgcgaagcaatactctatggacattatgg

SEQ ID NO: 457722 - DNA, 492 bp, Homo sapiens; identical to SEQ ID NO: 444827
  misc_feature: HEFZJCU01EMV9D.4.28.C06.1.454.heavy.3.raw

SEQ ID NO: 457723 - DNA, 438 bp, Homo sapiens; identical to SEQ ID NO: 444944
  misc_feature: HEFZJCU01BV5JC.51.5.A05.1.454.heavy.3.raw

SEQ ID NO: 457724 - DNA, 483 bp, Homo sapiens; identical to SEQ ID NO: 444924
  misc_feature: HEFZJCU01AP76I.10.35.D02.1.454.heavy.3.raw

SEQ ID NO: 457725 - DNA, 499 bp, Homo sapiens; identical to SEQ ID NO: 446055
  misc_feature: HEFZJCU01D7TQY.12.38.D05.1.454.heavy.3.raw

SEQ ID NO: 457726 - DNA, 538 bp, Homo sapiens
  misc_feature: HEFZJCU01DY714.52.49.E05.1.454.heavy.3.raw
cgcagtacgacacgaccggtgctcgatttagagcgactagcaacacacaaaggggacccaaaaaccacacccctccttgggagaatcccctagatcacagctcctcaccatggcctggacctggagcatccttttcttggtggcagcagcaacaggtgcccactcccaggttcacctggtgcagtcgggaggtgaggttaagaggcctggggcctcagtgaaggtcgcctgcaaggcttcaggttacaccctttccacgtctggtatcagttgggtgcgacaggcccccggacaagggcttgagtggatgggatggatcagcggtgacaacggcaacacaaattatggacagaagttccagggcagagtcaccatgaccgcggacacatccacgaacacagcctacatggagctgaggagcctaagatctgacgacaaccggccgtttagttactgtgtgagagattttagggacctcggccctttgggggagttagtcgtactttgactactgggcagggaacccaggtcaccgtct

SEQ ID NO: 457727 - DNA, 409 bp, Homo sapiens; identical to SEQ ID NO: 444519
  misc_feature: HEFZJCU01AG71E.3.41.D08.1.454.heavy.3.raw

SEQ ID NO: 457728 - DNA, 530 bp, Homo sapiens
  misc_feature: HEFZJCU01BD2H4.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggattgactactgggccagggaaccctggtcaccgtctcctcagcctccaccaaggg

SEQ ID NO: 457729 - DNA, 518 bp, Homo sapiens
  misc_feature: HEFZJCU01AVJPI.40.53.E09.1.454.heavy.3.raw
tctagcgactcacgaccggtgctcgatttagagagagtgtgttgggtttgggtgctcgatttagagtgagctcgttgggtttgggaggcttagttcagcctggggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatctccagagacaacgccaagaacacagtgtctctgcaaatggacagtctgagagccgaggacacgggtgtctattattgtacaaaagtggggactaatgaatatggtgtggacgtcgtggggccaagggaccacggtcgtcgcctcttatgcctccaccaagggcccatcggtcttccccctggcgccctgctccaggagcacctctgggggcacagcggccctggctgcctggtcaaggactacttccagtcg

SEQ ID NO: 457730 - DNA, 487 bp, Homo sapiens; identical to SEQ ID NO: 454270
  misc_feature: HEFZJCU01D2G3E.3.48.E04.1.454.heavy.3.raw

SEQ ID NO: 457731 - DNA, 323 bp, Homo sapiens; identical to SEQ ID NO: 449451
  misc_feature: HEFZJCU01BAGT3.18.17.B06.1.454.heavy.3.raw

SEQ ID NO: 457732 - DNA, 519 bp, Homo sapiens; identical to SEQ ID NO: 446650
  misc_feature: HEFZJCU01B3FWY.13.76.G10.1.454.heavy.3.raw

SEQ ID NO: 457733 - DNA, 521 bp, Homo sapiens
  misc_feature: HEFZJCU01CLMK0.51.31.C09.1.454.heavy.3.raw
cgatcgtatacacgaccggtgctcgatttagacgtctcatcaaggaaggaaggggtctgagagaggagcccagccctgggattttcaggtgttttcatgtggtgatcaggactgaacagagagaactcaccatggagtctgggctgacgtggctttttcttgtggctattttaaaaggtgtccagtgtgacgtgcagctggtggagtctgggggaggcttgatacagccgggggggtccctgagactctcatgtagaacctctggcttcatgtttagagtctatgacatgagttgggtccgccaggctccggggaaggggctggagtgggtctcaatgatcagtgatggtggaacgaccacaaactacgccgactccgtgaagggccggtgcaccatctccagagacaattcgaaggacactttatatctgcaactcaacagactgacacccgcggacacggccgtctactactgtgtgaaagaagacggaccgctgggacgagggagccaagaggagaaa

SEQ ID NO: 457734 - DNA, 527 bp, Homo sapiens
  misc_feature: HEFZJCU01ANJWE.5.64.F09.1.454.heavy.3.raw
atcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttgggtgcgacaggcccctggacaagggcttgagtggatgggagggatcgtccctgtctttggagcagcaaactacgcacatgatttccaggggagagtcacgattacggcggacgaatctacggccacagcctatctggagctgaacaacgtgagacctgaagacacggccgtttactactgcgcgagagatcgccccccccgaaggggccgaacgaggtatagtgggggcaacggctttgggccttctactactacta

SEQ ID NO: 457735 - DNA, 510 bp, Homo sapiens
  misc_feature: HEFZJCU01C3CIG.11.67.G01.1.454.heavy.3.raw
cgagagataccacgaccggtgctcgatttagagtatacatattgggtttggggagctctgagagaggagcccagccctgggattttcaggtgttttcatttggtgatcaggactgaacagagagagctcaccatggagtttgggctgagctggctttttcttgtggctattttaaaaggtgtccagtgtgaggtggagttattgcagtctggggggggcttggtgcagccgaggggtccctgagactctcctgtgtaggctctggattcagttttagcagctacgccatgacctgggtccgccaggctccgagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatacttactgtcgccaagaaatcccgtccagattattgcacgt

SEQ ID NO: 457736 - DNA, 528 bp, Homo sapiens
  misc_feature: HEFZJCU01D40AK.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacacgccgtgtattactgtaccacactccctgaaagcgtacaactactactactacgtatgacctc

SEQ ID NO: 457737 - DNA, 512 bp, Homo sapiens
  misc_feature: HEFZJCU01DGUKR.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggtaccg

SEQ ID NO: 457738 - DNA, 528 bp, Homo sapiens
  misc_feature: HEFZJCU01AK6R7.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcacatctcagaagacaattccaggaacacattgtatcttcaaatgaataacctgagagcgaggacacggccatgtattactgtgtggggcatttacttgaccccgtggggccggggaaccctggtcaccgtctccccaccctccaccg

SEQ ID NO: 457739 - DNA, 520 bp, Homo sapiens
  misc_feature: HEFZJCU01EOHW6.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagaccctccgatagcagtggctggtccactaggttgactacgtggggccagggaagcgttggtcaccgtctcctcagcct

SEQ ID NO: 457740 - DNA, 502 bp, Homo sapiens
  misc_feature: HEFZJCU01CZOPE.51.71.G05.1.454.heavy.3.raw
cgatcgtatacacgaccggtgctcgatttagtgtcgtcgcaagagagagggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttcccctcggcaccctcctccaagagcacctctgggggcacagcggccctgggctgcctggtcaaggactacttcc

SEQ ID NO: 457741 - DNA, 512 bp, Homo sapiens
  misc_feature: HEFZJCU01CQVJ9.16.21.B10.1.454.heavy.3.raw
  modified_base (478)..(478): a, c, t, g, unknown or other
  modified_base (495)..(495): a, c, t, g, unknown or other
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctgttggagttctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccaatataattctgtgcaaagcaaccggcngttaagtcacccatacnctttgactactgggccg

SEQ ID NO: 457742 - DNA, 491 bp, Homo sapiens; identical to SEQ ID NO: 446104
  misc_feature: HEFZJCU01BF26O.3.34.D01.1.454.heavy.3.raw

SEQ ID NO: 457743 - DNA, 518 bp, Homo sapiens
  misc_feature: HEFZJCU01EF4SA.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgctccatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 457744 - DNA, 532 bp, Homo sapiens
  misc_feature: HEFZJCU01BJMF8.4.59.F04.1.454.heavy.3.raw
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctccctgaggctgagctctgtgaccgccgcggacacggccgtgtatttctgtgcgagatctttcgatttttggagtggtaacccccttggctactggggccagggaaccctggtcaccgtctctcagcctccaccaagggccctacg

SEQ ID NO: 457745 - DNA, 488 bp, Homo sapiens
  misc_feature: HEFZJCU01EUJSN.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggagcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattattgtgtcccttgatttacta

SEQ ID NO: 457746 - DNA, 506 bp, Homo sapiens
  misc_feature: HEFZJCU01ASWHK.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctgggggcac

SEQ ID NO: 457747 - DNA, 515 bp, Homo sapiens; identical to SEQ ID NO: 452925
  misc_feature: HEFZJCU01APW87.12.25.C03.1.454.heavy.3.raw

SEQ ID NO: 457748 - DNA, 512 bp, Homo sapiens; identical to SEQ ID NO: 450914
  misc_feature: HEFZJCU01EZEFF.15.67.G01.1.454.heavy.3.raw

SEQ ID NO: 457749 - DNA, 534 bp, Homo sapiens
  misc_feature: HEFZJCU01A1ONQ.14.26.C04.1.454.heavy.3.raw
cgtctagtaccacgaccggtgctcgatttagtctagcgactttgggtttgggggtctcagagaggagccttagccctggactccaaggcctttccacttggtgatcagcactgagcacagaggactcaccatggagttggggctgagctgggttttccttgttgctattttagaaggtgtccagtgtgaggtgcagttggtggactctgggggaggcttggtccagcctggggggtccctgagactctcctgtgcagcctctggattcacctttagtaaatattggatgatgtgggtccgccaggctccagggaaggggctggagtgggtggcccacataaacgaagacggaattaagaaatactatctggactctgtgaagggccgattcaccatctccagagacaacgccgagaactcactgtatctgcagatgaacagcctgagagccgaagacacggccgtgtattactgtacgagagacgttgggtttaaaacttttgactatgggccagggaaccctggtcaccgtct

SEQ ID NO: 457750 - DNA, 464 bp, Homo sapiens
  misc_feature: HEFZJCU01DMHLW.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagttggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactgggacggggggaaaattggggccagggaaccctggtctccgtctcgtcagcctccaccaagggcccatcggtcttccccctggcgccctgctccaggagcacctccgagagcacagcggccctgggctgcctggtcaaggactacttcccacgagagta

SEQ ID NO: 457751 - DNA, 396 bp, Homo sapiens; identical to SEQ ID NO: 444469
  misc_feature: HEFZJCU01DY1V2.47.46.E02.1.454.heavy.3.raw

SEQ ID NO: 457752 - DNA, 507 bp, Homo sapiens
  misc_feature: HEFZJCU01AR4FC.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggg

SEQ ID NO: 457753 - DNA, 482 bp, Homo sapiens
  misc_feature: HEFZJCU01CDHN7.19.71.G05.1.454.heavy.3.raw
tactctcgtgcacgaccggtgctcgatttagtgtcgtcgcaagagagaggggggaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggagaggcccccatagacatgccacctcgtctctggtgct

SEQ ID NO: 457754 - DNA, 499 bp, Homo sapiens
  misc_feature: HEFZJCU01CUOGR.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtcgacccctgactgataaaccggactggttcgacccgtgggccagggaaccctggtcaccgtctcct

SEQ ID NO: 457755 - DNA, 533 bp, Homo sapiens
  misc_feature: HEFZJCU01BVG4M.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaagggcccatcggtcttcccctggcaccctcctccaacgagcacctctgggggcacagcggccctgggctgcctc

SEQ ID NO: 457756 - DNA, 507 bp, Homo sapiens; identical to SEQ ID NO: 455247
  misc_feature: HEFZJCU01AKA2N.16.34.D01.1.454.heavy.3.raw

SEQ ID NO: 457757 - DNA, 474 bp, Homo sapiens
  misc_feature: HEFZJCU01C4C3O.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccattcaccatctccagagacacttccgagaacacgctgtatctgcgaatgaacagcctgagagtcgaggacacggccatatattactgtgcgaaagatcctgaggcctataccacctcagtcagctggttcgaccctggggccagggaaccctggtcaccgtctcctcagcctccaccaagggcccatcggtcttccccctggcaccctcctccaagagcacctctgggggcacagcggccctggctgcctggtcaaggactacttccgagtagtaca

SEQ ID NO: 457758 - DNA, 515 bp, Homo sapiens
  misc_feature: HEFZJCU01CIMLB.40.44.D11.1.454.heavy.3.raw
tctagcgactcacgaccggtgctcgatttagcgcagtacgaagggggctttctgagagtcatggacctcctgcacaagaacatgaaacacctgtggttcttcctcctcctggtggcagctcccagatgggtcctgtcccaggtgcagctacagcagtggggcacaagactgttgaagccttcggagaccctgtccttcacctgcgctgtctatggtgggtccttcagtggttactactggacctggatccgccagcccccagggaaggggctggagtggattggggaaatcaatcatagtggaagcaccaactacaacccgtcactcaagagtcgactcaccatatcagtagacacgtccaagaaccagttctccctgaagctgagctctgtgaccgccgcggacacggctgtgtattactgtgcgagaggcttggtagcagtggctcccggggcttttgactactggggccagggaaccctggtcaccgtctcctcagcctccaccaaggcccc

SEQ ID NO: 457759 - DNA, 497 bp, Homo sapiens
  misc_feature: HEFZJCU01CRRRF.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaacgatgctttgatatgtgggaccg

SEQ ID NO: 457760 - DNA, 510 bp, Homo sapiens
  misc_feature: HEFZJCU01BR1PX.51.12.B01.1.454.heavy.3.raw
cgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttgacgacacggccgtctattactgtgcgacagaagcggcggacagaggttcgcttactggttcgaggctctccccacg

SEQ ID NO: 457761 - DNA, 525 bp, Homo sapiens
  misc_feature: HEFZJCU01COOI2.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagaaacaactccaggaacacaatgtatttggacctgaacagcctaagtcctgaggacacgggtgtatactactgtacgaaggaggggggaaccaggcggagttccaagtactccttgacgtctgggg

SEQ ID NO: 457762 - DNA, 394 bp, Homo sapiens; identical to SEQ ID NO: 444701
  misc_feature: HEFZJCU01C8QHB.3.12.B01.1.454.heavy.3.raw

SEQ ID NO: 457763 - DNA, 518 bp, Homo sapiens
  misc_feature: HEFZJCU01ESEYH.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcgtttttcttggtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaaagaacacggtgtatctgcaaatgaacagccctgagagccgaggaccacggccacatattactgtgcgaaagatcgtcgggctgggttccgcggtccggggta

SEQ ID NO: 457764 - DNA, 523 bp, Homo sapiens
  misc_feature: HEFZJCU01DP7OL.12.40.D07.1.454.heavy.3.raw
  modified_base (463)..(463): a, c, t, g, unknown or other
  modified_base (477)..(477): a, c, t, g, unknown or other
atacgacgtacacgaccggtgctcgatttagtgatagagcgtaacaacagagggctcaccatggagtttgggctgagcgtgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccgnggggaccctggtcntcgtctcccggcctccaccaaggcccatcggtcttcccctgcgcct

SEQ ID NO: 457765 - DNA, 538 bp, Homo sapiens
  misc_feature: HEFZJCU01BDFY3.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccggggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttcccctggcaccctcctccaagagcacctctgggggcacagcc

SEQ ID NO: 457766 - DNA, 501 bp, Homo sapiens
  misc_feature: HEFZJCU01DLIPT.11.27.C05.1.454.heavy.3.raw
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctcggaaccccgat

SEQ ID NO: 457767 - DNA, 395 bp, Homo sapiens
  misc_feature: HEFZJCU01COFE3.14.70.G04.1.454.heavy.3.raw
cgtctagtaccacgaccggtgctcgatttagtgtagtgtgaagggaaggggctggagtggatctcaactattagtggaagtgggagtggtgaatccacatattacgcaggctctgtgaagggccggttcaccatctccagagacaattccaacaacacactttatctgcaaatgaacagcctgcgagccgaggacacggccctatattactgtgcaagagatcgaacaggcccgtgggagcccgttgactactggggccagggaaccctagtcatcgtctcctcagcctccaccaagggcccatcggtcttccccctggcaccctcctccaagagcacctctgggggcacagcggccctgggctgcctggtcaaggactacttccgtactagacg

SEQ ID NO: 457768 - DNA, 510 bp, Homo sapiens; identical to SEQ ID NO: 456418
  misc_feature: HEFZJCU01C8WLB.12.78.H01.1.454.heavy.3.raw

SEQ ID NO: 457769 - DNA, 510 bp, Homo sapiens
  misc_feature: HEFZJCU01ECHFQ.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatggaactagaggagcctgagatctgacgacacggccgtatatttctgcgcgagagacgtaaaagtagacgtggtagttccggggggacgacatgactacc

SEQ ID NO: 457770 - DNA, 531 bp, Homo sapiens
  misc_feature: HEFZJCU01CGC27.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaacccg

SEQ ID NO: 457771 - DNA, 542 bp, Homo sapiens
  misc_feature: HEFZJCU01B50PV.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaaacgtccgaagtcgttatcactttgactcctggggccagggaaccctggtcagcgtctcttcagcctccaccaagggcccatcggtcttcccctcggccaccctcctccaagagcacctctgggggcacgagcggccctgggctgcctc

SEQ ID NO: 457772 - DNA, 475 bp, Homo sapiens; identical to SEQ ID NO: 445138
  misc_feature: HEFZJCU01CFT84.3.39.D06.1.454.heavy.3.raw

SEQ ID NO: 457773 - DNA, 509 bp, Homo sapiens
  misc_feature: HEFZJCU01A7I2O.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttggggagcctgacatctgacgacacggccgtctattactgtgcgagagtcccacgatccggtgagcctacggcagcggcctttgacttctggggccg

SEQ ID NO: 457774 - DNA, 499 bp, Homo sapiens; identical to SEQ ID NO: 453163
  misc_feature: HEFZJCU01CNE8I.22.5.A05.1.454.heavy.3.raw

SEQ ID NO: 457775 - DNA, 494 bp, Homo sapiens
  misc_feature: HEFZJCU01BLD1N.48.82.H05.1.454.heavy.3.raw
agtatacatacacgaccggtgctcgatttagtcgagctctctcgcgggcacgaccggtgctcgatttagtgacatctcgcagttctttggggatgctttctgagagtaacatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctgggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgc

SEQ ID NO: 457776 - DNA, 505 bp, Homo sapiens
  misc_feature: HEFZJCU01BYDKL.48.30.C08.1.454.heavy.3.raw
agtatacatacacgaccggtgctcgatttagtctgacgtcaaagggaaaggggggggaggcttggtacagcctggcaggtccctgaaactctcctgtgtagcctctggattcaggttgggcgattatgccatgcaatgggtccggcaaggtccagggaagggcctggagtgggtctcaggcatcgattggaaaagcgagaagattgactatgcggagtctgtgaaggggcgattcatcatctccagagacaacgccaagaactccctgtatttgcagatgaacaatctgagacctgacgacacggccttgtattattgtgcaaaagttgtggagtcacagtctctggactacggtatggacgtctggggccaagggaccacggtcacagtctcctcagcctccaccaagggcccatcggtcttcccctggcaccctcctccaagagcacctctgggggcacagcggccctggctgcctggtcaaggactacttcctatgtatact

SEQ ID NO: 457777 - DNA, 375 bp, Homo sapiens
  misc_feature: HEFZJCU01D65B8.5.23.C01.1.454.heavy.3.raw
atcagacacgcacgaccggtgctcgatttagtacacgtgattagggattggggagagtctatcataccgggagccaccaactacaatccgtccctcaagagtcgagtcaccatatctatagacacgtcgaacaaccagttctccctgaaggtgacctctgtgaccgccgcggacacggccgtctattactgtgcgcggatttcgagagggacaggactactatatcgacgtctggggcagagggaccacggtcatcgtctcctcagcctccaccaagggcccatcggtcttccccctggcaccctcctccaagagcacctctgggggcacagcggccctgggctgcctggtcaaggactacttcccgtgtctgat

SEQ ID NO: 457778 - DNA, 502 bp, Homo sapiens
  misc_feature: HEFZJCU01EZNTZ.13.10.A10.1.454.heavy.3.raw
tcacgtactacacgaccggtgctcgatttagcgtcgatctcagggggtctcagagaggagccttagccctggactccaaggcctttccacttggtgatcagcactgagcacagaggactcaccatggaattggggctgagcgtggtttcgtgtaggcgtatttagtaaggtgtccagtgtgaggtgcagctggtggagtctgggggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatgg

SEQ ID NO: 457779 - DNA, 480 bp, Homo sapiens; identical to SEQ ID NO: 446171
  misc_feature: HEFZJCU01CP31B.22.36.D03.1.454.heavy.3.raw

SEQ ID NO: 457780 - DNA, 551 bp, Homo sapiens
  misc_feature: HEFZJCU01A36EN.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcagtcgacactttgattactggggccgggaaccctggtcgccgtctcctcagcctccaccaagggcccatcggtcttcccctggcgccctcgcctacaggacgcctaccgtccggagacgacgacgacgtcgggccctgggcctggtcctagggtactaacggtacctacgttaccgtagtaccgtactcgtacg

SEQ ID NO: 457781 - DNA, 499 bp, Homo sapiens
  misc_feature: HEFZJCU01AV291.53.81.H04.1.454.heavy.3.raw
cgcgtatacacacgaccggtgctcgatttagtagtgtagattcgcggggctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaagggactggagtgggtggcagttatatcatttgatggaagcactacatactacgcaaactccgtgaagggccgattcaccatctccagagacgattccaggaacactctgtttctccaaatgaacagcctgagagctgaggacacggctctttattactgtgcgagagattctggatacagccattattac

SEQ ID NO: 457782 - DNA, 482 bp, Homo sapiens
  misc_feature: HEFZJCU01BZBB3.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccttgccaccctcctccaagagcacctctgggggcacagcggcctgggctgcctggtcaaggactacttcctagagacacg

SEQ ID NO: 457783 - DNA, 498 bp, Homo sapiens; identical to SEQ ID NO: 455901
  misc_feature: HEFZJCU01D3GAC.16.37.D04.1.454.heavy.3.raw

SEQ ID NO: 457784 - DNA, 504 bp, Homo sapiens
  misc_feature: HEFZJCU01EC876.11.72.G06.1.454.heavy.3.raw
  modified_base (469)..(469): a, c, t, g, unknown or other
  modified_base (492)..(492): a, c, t, g, unknown or other
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcgaggccctatcctanagtgaccactccacgctggtacnctctggggccac

SEQ ID NO: 457785 - DNA, 514 bp, Homo sapiens; identical to SEQ ID NO: 448304
  misc_feature: HEFZJCU01DXZJE.26.12.B01.1.454.heavy.3.raw

SEQ ID NO: 457786 - DNA, 527 bp, Homo sapiens; identical to SEQ ID NO: 456786
  misc_feature: HEFZJCU01AU4YD.14.35.D02.1.454.heavy.3.raw

SEQ ID NO: 457787 - DNA, 505 bp, Homo sapiens; identical to SEQ ID NO: 452639
  misc_feature: HEFZJCU01ANADY.17.25.C03.1.454.heavy.3.raw

SEQ ID NO: 457788 - DNA, 516 bp, Homo sapiens
  misc_feature: HEFZJCU01CIDC2.26.57.F02.1.454.heavy.3.raw
agactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaatttatgctgcgtcggtgcaaggcaggttcaccatctccagagatgattcagagaacacggcgtatctgcaaatgaacagcctgaaaaccgaggacacggccgtgtattactgtgccagacatccgtcgtattacgtatttttcagtggt

SEQ ID NO: 457789 - DNA, 519 bp, Homo sapiens
  misc_feature: HEFZJCU01CTYSA.12.11.A11.1.454.heavy.3.raw
  modified_base (502)..(502): a, c, t, g, unknown or other
atacgacgtacacgaccggtgctcgatttagctacgactgcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagagtctcctgtacaacctctggattcatgtttagtagtcattggatgaactgggtccgccaggctccagggaaggggctggagtgggtggccaacataaagcaagatggaagtgagaaatactatgtggactctgtgaagggccgattcacaatctccagagacaacgccaagactcactgtatctgcaaataaacagcctgaaagccgaggacacggctgtgtatttctgtgcgaggacgtcctacggtgacaatttatcaaaccngaacaaagttcgttacg

SEQ ID NO: 457790 - DNA, 437 bp, Homo sapiens
  misc_feature: HEFZJCU01CVGQK.40.27.C05.1.454.heavy.3.raw
tctagcgactcacgaccggtgctcgatttagacgcgatcgaagggtttggggctgggtccgccggcccccagggaaggggctggagtggattgcgagcatatattatgatgagagcgccctctacaaccccccccctctacaacccctccctcaagagtcgggtcaccatatctatagacacgtccaacagtcaattctccctggacttgacctctgtgaccgccgcagacacggctgtatattcctgtgcgacccacggaggggatggccccaaatctgcctactttgaccactgggccagggaaccttggtcaccgtctcctcagcctccaccaagggcccatcggtcttccccctggcgccctgctccaggagcacctccgagagcacagcggccctgggcctgcctggtcaaggactacttccagtcgctaga

SEQ ID NO: 457791 - DNA, 373 bp, Homo sapiens; identical to SEQ ID NO: 454745
  misc_feature: HEFZJCU01ENZVX.49.30.C08.1.454.heavy.3.raw

SEQ ID NO: 457792 - DNA, 500 bp, Homo sapiens
  misc_feature: HEFZJCU01B2HZA.48.31.C09.1.454.heavy.3.raw
agtatacatacacgaccggtgctcgatttagacgtctcatcaaggaaggaaggggtctgagagaggagccttagccctggattccaaggcctatccacttggtgatcagcactgagcaccgaggattcaccatggaactggggctccgctgggttttccttgttgctattttagaaggtgtccagtgtgaagtacagctggtggagtctgggggaggcctggtcaagcctggggggtccctgagactctcctgtgcaacctctggattcacattcactagatataccatgaactgggtccgccaggctccagcgaaggggctggagtgggtctcctccataagtagtggcagttcttacttacattacgcagactcagtgaagggccgattcgccatctccagagacaacgccaacaactcactgtttctgcagatggacaacctgagaggcgaggacacggctgtatattactgtgtctccccatacatcgcagctcgt

SEQ ID NO: 457793 - DNA, 496 bp, Homo sapiens; identical to SEQ ID NO: 444697
  misc_feature: HEFZJCU01AGXBW.16.37.D04.1.454.heavy.3.raw

SEQ ID NO: 457794 - DNA, 505 bp, Homo sapiens
  misc_feature: HEFZJCU01DKHAQ.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggagggctggagtggctcgcacttatttacagtggcggcactacatactacacagacttcgcgaggggccgattcaccatctccagagacgattccaagaacacgttgtatcttcaatgaacagcctgacagtcgacgacacggccatgtatttttgtgcgagcgacccggggctcctcaatggctttcattacg

SEQ ID NO: 457795 - DNA, 509 bp, Homo sapiens; identical to SEQ ID NO: 448615
  misc_feature: HEFZJCU01EWVBM.7.28.C06.1.454.heavy.3.raw

SEQ ID NO: 457796 - DNA, 516 bp, Homo sapiens
  misc_feature: HEFZJCU01B4EBQ.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaaggcccatcggtcttcccctggcaccctcctccaagagcacctctgggggcacagcggccctggctgcctggtcaaggactactcctagagacacg

SEQ ID NO: 457797 - DNA, 526 bp, Homo sapiens
  misc_feature: HEFZJCU01EHW49.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctggggccaggggaccctggtcatcgtctccccagcctccaccaagggcccatcggtcttcccctggccgcctcg

SEQ ID NO: 457798 - DNA, 522 bp, Homo sapiens
  misc_feature: HEFZJCU01B2NM1.12.40.D07.1.454.heavy.3.raw
atacgacgtacacgaccggtgctcgatttagtgatagagcgtaacaacagagggctcaccatggagtttgggctgagcggtcggtttcgtcgtaggcgtctttaagtaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggacctggcatcgtctccccagcctccaccaagggcccatcggtcttcccctggcg

SEQ ID NO: 457799 - DNA, 537 bp, Homo sapiens; identical to SEQ ID NO: 445697
  misc_feature: HEFZJCU01DZRRH.14.57.F02.1.454.heavy.3.raw

SEQ ID NO: 457800 - DNA, 499 bp, Homo sapiens
  misc_feature: HEFZJCU01CFZWS.47.38.D05.1.454.heavy.3.raw
agctcacgtacacgaccggtgctcgatttagtatctgatagttgggtttgggggagagcatcacccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagcctggggcctcagtgaaggtctcctgcaaggcttctggatacagcttcaccgactactatttgcactgggtgcgacgggcccctggacaagggcttgagtggatgggacggatcagccctaacagtggtggcacaaactatgcacagaggtttcagggcagggtcaccatgaccagggacaacgtccatcagtacagcctacatggagctgagcagtctgagacctgacgacacggccgtgtattattgtgcgttagttacggacgattacgacgttttgattggt

SEQ ID NO: 457801 - DNA, 519 bp, Homo sapiens
  misc_feature: HEFZJCU01CSSXX.48.28.C06.1.454.heavy.3.raw
agtatacatacacgaccggtgctcgatttagagctcacgtattgggtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaagggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccccttggccgccctgctccacgg

SEQ ID NO: 457802 - DNA, 488 bp, Homo sapiens
  misc_feature: HEFZJCU01ESL56.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacatggtctatctgcacctgaccagcctgagaactgacgacacgtctctctactactgtgcgagagagttgacg

SEQ ID NO: 457803 - DNA, 520 bp, Homo sapiens
  misc_feature: HEFZJCU01DCF96.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtggggccggggaaccctggtcaccgtctcttcagcctccaccaagggcccatcggtcttccccctggcaccctcctccaacgagcacctctggggcacagcc

SEQ ID NO: 457804 - DNA, 497 bp, Homo sapiens
  misc_feature: HEFZJCU01CU6RD.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctgggagtgggtggcgattatatcacatgatggaactaatagacgctatgccgactccgtgaagggccgattcaccatctccagagacaattccaagaacacgcagtatctgcaaatgaacagcctgagagctagaggacacggctgtgtattactgtgggagagatgggaggtcggatattgta

SEQ ID NO: 457805 - DNA, 484 bp, Homo sapiens
  misc_feature: HEFZJCU01EA827.51.28.C06.1.454.heavy.3.raw
cgatcgtatacacgaccggtgctcgatttagagctcacgtattgggtttgggggctctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctgggagtgggtggcagttatatcatatgatggaagcaagatatactatgtagactccgtgaagggccgattcatcatctccagagacaactccgagaacacgctgtatctgcaaatgaacaggctgagagctgaagacacggctgtatattactgtgcgtaaa

SEQ ID NO: 457806 - DNA, 498 bp, Homo sapiens
  misc_feature: HEFZJCU01DK3XW.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctgggggtggctacgagtactggtacttcgatctctggggccgtggcaccctgctgactgtctcctcagcctccaccaagggcccatcggtcttcccctggccgccctgctccaggagcacctccgagagcacagcggccctgggctgcctggtcaaggactac

SEQ ID NO: 457807 - DNA, 496 bp, Homo sapiens
  misc_feature: HEFZJCU01EFQL5.51.53.E09.1.454.heavy.3.raw
cgatcgtatacacgaccggtgctcgatttagagagagtgtgttgggtttgggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 457808 - DNA, 531 bp, Homo sapiens
  misc_feature: HEFZJCU01C9KG3.12.40.D07.1.454.heavy.3.raw
  modified_base (520)..(520): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctggtctattattgcgcgagagagacacacgaacctactggccaatactatgggggcttgttctggggccaggggaccctggtcatcgtctccccagcctccaccaacgggcccatcggtcttcccccnggtcgccctcg

SEQ ID NO: 457809 - DNA, 500 bp, Homo sapiens
  misc_feature: HEFZJCU01DRXKK.14.55.E11.1.454.heavy.3.raw
cgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtggtgatccga

SEQ ID NO: 457810 - DNA, 511 bp, Homo sapiens
  misc_feature: HEFZJCU01C76RX.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcgagggggccgggatattgttatagaaccacctgctatctgagctggttcgactgctggggccagggaaccctggtcaccg

SEQ ID NO: 457811 - DNA, 339 bp, Homo sapiens; identical to SEQ ID NO: 444436
  misc_feature: HEFZJCU01DO83P.47.38.D05.1.454.heavy.3.raw

SEQ ID NO: 457812 - DNA, 510 bp, Homo sapiens
  misc_feature: HEFZJCU01EXCR3.49.82.H05.1.454.heavy.3.raw
agtcgagagacacgaccggtgctcgatttagtcgagctctctcgcggggagctctcagagaggtgccttagccctggattccaaggcatttccacttggtgatcagcactgaacacagaggactcaccatggaattggggctgtgctgggttttccttgttgctattttagaaggtgtccactgtgacgtgcagctggtggagtctgggggagccttggttcagcctggagggtccctgagactctcctgtgcagcctctggaatcgccttcaataagttttggatgtactgggtccgccaagttccagggaaggggctgatgtgggtctcacgtattgatgttgatgggagttacagtgaccacgcggactctgtgaagggccgattcaccgtctccagagaaaacgccaagaacacggtgtatctgcaaatgatggcctgagagccgaggacacggcagtttattactgtgcaacgaggcgtgtggtcggtactgtcgacctggtacg

SEQ ID NO: 457813 - DNA, 519 bp, Homo sapiens; identical to SEQ ID NO: 446650
  misc_feature: HEFZJCU01CRAOO.13.76.G10.1.454.heavy.3.raw

SEQ ID NO: 457814 - DNA, 392 bp, Homo sapiens; identical to SEQ ID NO: 444456
  misc_feature: HEFZJCU01AKWR0.7.60.F05.1.454.heavy.3.raw

SEQ ID NO: 457815 - DNA, 531 bp, Homo sapiens
  misc_feature: HEFZJCU01EP2W1.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaagggcccatcggtcttcccctggccaccctcctccaagagcacctctggggcacagcggccctgggctgcctc

SEQ ID NO: 457816 - DNA, 523 bp, Homo sapiens
  misc_feature: HEFZJCU01CZQLV.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaattgaataacctgagagccgaggacacggccatgtattactgtgtggggcatttacttgaccccttgggggccgggaaccctggtcaccgtctcctcagt

SEQ ID NO: 457817 - DNA, 500 bp, Homo sapiens; identical to SEQ ID NO: 446062
  misc_feature: HEFZJCU01EFJPM.12.38.D05.1.454.heavy.3.raw

SEQ ID NO: 457818 - DNA, 534 bp, Homo sapiens
  misc_feature: HEFZJCU01CDP43.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatccctgaaagcgtacaactactactactacggtatggacctctggggccg

SEQ ID NO: 457819 - DNA, 477 bp, Homo sapiens
  misc_feature: HEFZJCU01CVZQP.21.14.B03.1.454.heavy.3.raw
tcgtcgctcgcacgaccggtgctcgatttagtgtgagtagtttgggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaagggcccatcggtcttcccctggcaccctcctccaagagcacctctgggggcacagcggccctgggctgcctggtcaggactacttcccgagcgacga

SEQ ID NO: 457820 - DNA, 508 bp, Homo sapiens
  misc_feature: HEFZJCU01BUEDY.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctatttattgtgcgcgacatgactacgctcaattcgtggggccaggggacg

SEQ ID NO: 457821 - DNA, 394 bp, Homo sapiens
  misc_feature: HEFZJCU01B9ODZ.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctgacaccctcctccaagagcacctctggggcacagcggcctgggctgcctggtcaaggactacttcctacgtgagct

SEQ ID NO: 457822 - DNA, 522 bp, Homo sapiens
  misc_feature: HEFZJCU01DFWT1.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctgggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggactcaccctggtctacttcgatctctgggccgt

SEQ ID NO: 457823 - DNA, 522 bp, Homo sapiens; identical to SEQ ID NO: 449550
  misc_feature: HEFZJCU01BIXGK.12.40.D07.1.454.heavy.3.raw

SEQ ID NO: 457824 - DNA, 498 bp, Homo sapiens
  misc_feature: HEFZJCU01BV6RB.13.10.A10.1.454.heavy.3.raw
tcacgtactacacgaccggtgctcgatttagcgtcgatctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggaggcttggtccagcctggggggtccctgagactctcctgtgcagcctctggattcacctttagtagctattggatgagctgggtccgccaggctccagggaagggctggagtgggtggccaacataaagcaagttggaagtgagaaatactatgtggactctgtgaagggccgattcaccatctccagagacaacgccaagaactcactgtatctgcaaatgaacagcctgagagccgaggacacggctgtctattactgtgcgagagagttgggggcggaaggtatagca

SEQ ID NO: 457825 - DNA, 467 bp, Homo sapiens; identical to SEQ ID NO: 445004
  misc_feature: HEFZJCU01DFF2C.16.78.H01.1.454.heavy.3.raw

SEQ ID NO: 457826 - DNA, 515 bp, Homo sapiens
  misc_feature: HEFZJCU01A26BY.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagttttatggcgatggctgggtggacagatcactggggccac

SEQ ID NO: 457827 - DNA, 492 bp, Homo sapiens; identical to SEQ ID NO: 444827
  misc_feature: HEFZJCU01ES1B4.4.28.C06.1.454.heavy.3.raw

SEQ ID NO: 457828 - DNA, 491 bp, Homo sapiens
  misc_feature: HEFZJCU01DH1DQ.48.39.D06.1.454.heavy.3.raw
  modified_base (467)..(467): a, c, t, g, unknown or other
agtatacatacacgaccggtgctcgatttagtgacatctcgcagttctttggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgntgctttgatatgtgggccagggac

SEQ ID NO: 457829 - DNA, 523 bp, Homo sapiens
  misc_feature: HEFZJCU01D2PXB.12.40.D07.1.454.heavy.3.raw
  modified_base (516)..(516): a, c, t, g, unknown or other
atacgacgtacacgaccggtgctcgatttagtgatagagcgtaacaacagagggctcaccatggagtttgggctgagcgtggtttcgtcgttaggctctttaagtaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggcagggccctggtcatcgtctcccagcctccaccaggcccatcggtcttcccctggccncccgtcg

SEQ ID NO: 457830 - DNA, 545 bp, Homo sapiens
  misc_feature: HEFZJCU01BKU2Y.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgagttcaccatctcagaagacaattccaggaacacattgtatcttcaaatgaataacctgagagccgaggacacggccatgtattactgtggtggggcagtttacttcgaccccgttgggggcccgggggaacccgtgggtacaccgtctcccccgaccctccaacccg

SEQ ID NO: 457831 - DNA, 515 bp, Homo sapiens
  misc_feature: HEFZJCU01D4RFA.40.9.A09.1.454.heavy.3.raw
tctagcgactcacgaccggtgctcgatttagcgagacgcgcaggggaggtctcagagaggagccttagccctggactccaaggcctttccacttggtgatcagcactgagcacagaggactcaccatggaattggggctgagctgggttttccttgttgctattttagaaggtgtccagtgtgcggtgaaactagcggagtctgggggaggcttggtccagcctggggggtccctaagactctcctgcgcagcctctggattcatgtttagtgattattggatggcttgggtccgtcaggctccagggaaagggctggagtttgtggccaagatgaaccacgacggaaatgagaaaaactatgcggactctgtgaagggccgattcaccatttccagagacaacgccaagaagtcactctctctacacatgaccagcctgacagccgaggacacggctgtttattactgtgcgagagatggcacgtcggggcggtgactttgactactggggcca

SEQ ID NO: 457832 - DNA, 510 bp, Homo sapiens
  misc_feature: HEFZJCU01DDJMI.4.80.H03.1.454.heavy.3.raw
agcactgtagcacgaccggtgctcgatttagctgtgcgtcgaagggaaagggggagagaggagtccagccctgggattttcaggtgttttcatttggtgatcaggactgaacagagagaactcaccatggaggttgggctgaggtggctttttcttgtggctactttaaaagctgcccagtgtgaggtgcatttgttggagtctgggggaggcttgattcagacgggagggtccctgagactctcctgtgcagcctctggattcacatttatcagccatgccatgagctgggtccgccaagctccagggaagggctggagtgggtctcaagtatgatgccagcgcccgtaacacgttccacgcagattccgtgaagggccggttcgccatctccagagacaattccaggaacgttctctatttacaaatgaacactttgagagtcgaagacacggccatgtattactgtgcgaaggggaatgtattaggtccggctcgggatccttttga

SEQ ID NO: 457833 - DNA, 504 bp, Homo sapiens
  misc_feature: HEFZJCU01EBO9M.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttcccctggcacctcctccaagagcacctctgggggcacagcggcctgggctgcctggtcaaggactacttcctagtacgtga

SEQ ID NO: 457834 - DNA, 546 bp, Homo sapiens
  misc_feature: HEFZJCU01A3YLF.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggcttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgcccctataatggtggttggagtcggggagtttggttccgtggggccaggggaaccctggtctaccg

SEQ ID NO: 457835 - DNA, 529 bp, Homo sapiens
  misc_feature: HEFZJCU01BTSN5.52.55.E11.1.454.heavy.3.raw
cgcagtacgacacgaccggtgctcgatttagcactcgcacgttgggtttgggggctctgggagaggagcccagcactgggattccgaggtgtttccattcagtgatctgcactgaacacagaggactcgccatggagtttgggctgagctgggttttccttgttgctattttaaaaggtgtccagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcgggagcagcccgtaacttctggggccagggaacccgggtcaccgtctcctcagcctccaccaagggcccatcggtcttccccctggcaccctcctccaagagcacctctc

SEQ ID NO: 457836 - DNA, 527 bp, Homo sapiens
  misc_feature: HEFZJCU01EG09Z.14.55.E11.1.454.heavy.3.raw
cgtctagtaccacgaccggtgctcgatttagcactcgcacgttgggtttggggggaagaggaagactgacggtccccccaggagttcaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtggtgatccaggtatgattgtgtactactaccacggtctggacgtcgtggggccaagggaccgacggtcaccgtctcctcagcctccaccaagggcccatcggtcttcccctggcaccctcctccaagagcacctctgggggcacagcggcctggctgcctggtcaaggactacttaccg

SEQ ID NO: 457837 - DNA, 514 bp, Homo sapiens
  misc_feature: HEFZJCU01CP3UY.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagccaagacagagttttggagttggttactgttggactactttgactacgtggggccaggggaaccctggt

SEQ ID NO: 457838 - DNA, 504 bp, Homo sapiens; identical to SEQ ID NO: 452932
  misc_feature: HEFZJCU01E1HZ4.9.33.C11.1.454.heavy.3.raw

SEQ ID NO: 457839 - DNA, 516 bp, Homo sapiens
  misc_feature: HEFZJCU01C2XEO.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaagggaggggggaaccagcgggagttccaagtactcctttgtacg

SEQ ID NO: 457840 - DNA, 519 bp, Homo sapiens
  misc_feature: HEFZJCU01D7M4K.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctcttttacacctccctgactctgggcatgaacccggt

SEQ ID NO: 457841 - DNA, 531 bp, Homo sapiens
  misc_feature: HEFZJCU01C177L.51.78.H01.1.454.heavy.3.raw
cgatcgtatacacgaccggtgctcgatttagtgtgagtagtttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctccaccaaggcccatcggtcttcccctggcaccctcctccaagagcacctctc

SEQ ID NO: 457842 - DNA, 515 bp, Homo sapiens
  misc_feature: HEFZJCU01B11ZB.52.40.D07.1.454.heavy.3.raw
cgcagtacgacacgaccggtgctcgatttagtgatagagcgtaacaacagagggacagggtctgtgaagccttcacagaccctgtccctcacctgcactgtctctggtggctccatcaacagtggtagtttcttctggacctggatccggcagcccgccgggaagggactggagtggattgggcgtatccataccagtggcatcaccgagtacaccccttccctcaagagtcgactctccatatcactagacgcgtccaagaaccaggtcttcctgatggtgagctctgtgaccgccgcagactcggccagatattactgtgcgagagcgggggcggctaatgtcgcaggctattacttcggtttggacgtctggggccaagggaccacggtcaccgtctccgcagcctccaccaagggcccatcggtcttccccctggcaccctcctccaagagcacctctgggggcacagcggccctgggctgcctggtcaaggactacttcctatacgatcg

SEQ ID NO: 457843 - DNA, 504 bp, Homo sapiens
  misc_feature: HEFZJCU01A3VEI.12.79.H02.1.454.heavy.3.raw
  modified_base (484)..(484): a, c, t, g, unknown or other
atacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccaggtgcatctggagcagtctggagctgaggtgaaggagcctggggcctcagtaaaatctcctgcaagtcttctggttacgcactcaccgccaatggtatcagctggctgcgacaggcccctggacaaggtcttgagtggatgtcatggatcagcactttcaatggagacacaaagtatggagagaacttccagggcagagtcaccatgaccactgacagatcaacgaacatagcctattggaactggaggggcctgaggtctgacgacacggccctctattattgtgcgagaattaatttcgttattgttctggtgtgtntgttcaatgtttgaccattc

SEQ ID NO: 457844 - DNA, 510 bp, Homo sapiens
  misc_feature: HEFZJCU01BKOIH.48.75.G09.1.454.heavy.3.raw
agtatacatacacgaccggtgctcgatttagtatagacatcagggggactcctgtgccccaccatggacacactttgctccacgctcctgctgctgaccatcccttcatgggtcttgtcccagatcaccttgaaggagtctggtcctacgctggtgaaacccacacagaccctcacactgacctgcaccttctcgggcttctcactcactcgtagtggggaggctgtggcctggattcgtcagcccccagggaaggccctggagtggcttgctctcatttactgggatactgatgaccgctacactccagctctgaaaaacaggctcaccatcgccatggacacctccaaaaacaggtggtccttaaatgaccaacatggacccaatggacagcgcgacatattactgtgcacacattgattgtggtccaccaggtgtcccgggccctttgatatcgtggggccgggggacattcgtcaccgtctctgcagcctccaccaagggcctacg

SEQ ID NO: 457845 - DNA, 526 bp, Homo sapiens
  misc_feature: HEFZJCU01AJWSW.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatccctgaaagcgtcaactactactactacggtatggacctc

SEQ ID NO: 457846 - DNA, 531 bp, Homo sapiens
  misc_feature: HEFZJCU01BIRGI.40.20.B09.1.454.heavy.3.raw
tctagcgactcacgaccggtgctcgatttagtgtagtgtgaagggggagagaggagccttagccctggattccaaggcctatccacttggtgatcagcactgagcaccgaggagtcaccatggaactgggactccgctgggttttccttgttgcgattttagaaggtgtcaagtgtgaggtgcgactggtcgagtctgggggaggcctggtcaagccgggggggtccctgagactctcctgtgcagcctctggactcaccttcaggagtttcagtatgaattgggtccgccaggctccagggaaggggctggagtgggtctcatccatcagcagtggtagcacttacatacactatgcagactcagtgaagggccgattcaccatctccagagacaacgccgggaactccctgtatctgcaaatgaagagcctgcgagccgaggacacggggtgtttattattgtactaaaggacaagagggactttgggagtactactacggtatggacgtctggggccaaggggacccg

SEQ ID NO: 457847 - DNA, 529 bp, Homo sapiens
  misc_feature: HEFZJCU01A9ORV.9.34.D01.1.454.heavy.3.raw
tgatacgtctcacgaccggtgctcgatttagatcgtctgtgttgggtttgggctgacctggctttttctcgtggctgttttaaaaggtgtccagtgtgaggttcaactgttggagtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggccaccctcctccaagagc

SEQ ID NO: 457848 - DNA, 466 bp, Homo sapiens
  misc_feature: HEFZJCU01B060V.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaaatactggggacggggggaaaattggggccagggaaccctggtctccgtctcgtcagcctccaccaagggcccatcggtcttccccctggcgccctgctccaggagcacctccgagagcacagcggccctgggctgcctggtcaaggactacttcccacgagagta

SEQ ID NO: 457849 - DNA, 508 bp, Homo sapiens
  misc_feature: HEFZJCU01EL4W5.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaaggggccggagtgggtgtcagtcattagtagtagtggtgatagaatttaccacacagactccgtgaagggccgcttcaccatctctagagacaattcccagaacacactgtatctgcaaatgactaggctgagagccgacgacacggccatttattactgcgcgaaggatatacgggtcacaacggtggctacgcgttt

SEQ ID NO: 457850 - DNA, 503 bp, Homo sapiens
  misc_feature: HEFZJCU01CP32R.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaaggcccatcggtcttcccctggcaccctcctccaagagcacctctgggggcacagcggcccgtgggctgcctggtcaaggactacttccgctacgtaga

SEQ ID NO: 457851 - DNA, 489 bp, Homo sapiens; identical to SEQ ID NO: 444791
  misc_feature: HEFZJCU01D4918.47.85.H08.1.454.heavy.3.raw

SEQ ID NO: 457852 - DNA, 524 bp, Homo sapiens
  misc_feature: HEFZJCU01BLND5.12.40.D07.1.454.heavy.3.raw
  modified_base (519)..(519): a, c, t, g, unknown or other
atacgacgtacacgaccggtgctcgatttagtgatagagcgtaacaacagaggactcaccatggagtttgggctgagcgtgggttttccgtcgttagctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctcaccaagggcccatcggtcttccccnggtcg

SEQ ID NO: 457853 - DNA, 497 bp, Homo sapiens
  misc_feature: HEFZJCU01CB5J3.49.38.D05.1.454.heavy.3.raw
agtcgagagacacgaccggtgctcgatttagtatctgatagttgggtttggggggaagaggaagactgacggtcctcccaggagttcaggtgctgggcaccgtgggcatgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacaactctgagacgtgaggacacggctgtctattactgtgcgactgagatgtcttattacgatgccagtgctttagtaccgttcgacccctggggccagggagccctggtcaccgtctcctcagcttccaccaagggccatcggtcttcccctgcgcct

SEQ ID NO: 457854 - DNA, 497 bp, Homo sapiens
  misc_feature: HEFZJCU01CF5ZI.51.71.G05.1.454.heavy.3.raw
cgatcgtatacacgaccggtgctcgatttagtgtcgtcgcaagagagagggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagatacggttcttctacaaatgaacagcctgagagctgaggagacggctatgttttactgtgcgagagggaactcgattac

SEQ ID NO: 457855 - DNA, 402 bp, Homo sapiens; identical to SEQ ID NO: 444584
  misc_feature: HEFZJCU01ERXJQ.10.77.G11.1.454.heavy.3.raw

SEQ ID NO: 457856 - DNA, 494 bp, Homo sapiens
  misc_feature: HEFZJCU01CH1AS.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtgg

SEQ ID NO: 457857 - DNA, 477 bp, Homo sapiens
  misc_feature: HEFZJCU01EBN5I.3.39.D06.1.454.heavy.3.raw
agacgcactccacgaccggtgctcgatttagtgacatctcgcagttctttgggttttggggggtccctgagactctcatgtacaggctctgagttcagcgtcactaaatactacatgagctgggtccgccaggctccagggaggggactggactgggtctccagtgttaacagcgatggaagtacatattatgcagactccgtgaagggccgattcaccatctccagagacaattccaagaacactctgtatcttcaaatgaacagcctgagagccgaggacacggccttctattactgtgcgagcgatcacgggcggagtctgatactttcttggggccagggaaccctggtcaccgtctcctcagcctccaccaagggcccatcggtcttcccctggcgccctgctccaggagcacctccgagaggcacagcggccctggggctgcctggtcaaggactacttccgagtgcgtct

SEQ ID NO: 457858 - DNA, 508 bp, Homo sapiens
  misc_feature: HEFZJCU01CTD6C.49.77.G11.1.454.heavy.3.raw
agtcgagagacacgaccggtgctcgatttagctagtcactcaagggaaaggggagctctgagagaggagccttagccctggattccaaggcctatccacttggtgatcagcactgagcaccgaggattcaccatggaactggggctccgctgggttttccttgttgctattttagaaggtgtcccttgtcaagtgcagctggtggagtctgggggaaaggtggtcaagccgggggggtccctgagactctcctgtgcagcctctggattcaccttccgttcctataccatgaactggatccgccaggctccagggaggcgactggagtgggtctcatctattagtggtagaggtgattactacaactacgcagactcactggagggccgattcaccatctccagagacaacaccaagaatttactgtatctgcaaatggacagcctgagagccgacgacacggctgtctattactgtgcgagagttcgggatattgccgtagtcccag

SEQ ID NO: 457859 - DNA, 497 bp, Homo sapiens
  misc_feature: HEFZJCU01AQWV7.40.34.D01.1.454.heavy.3.raw
tctagcgactcacgaccggtgctcgatttagatcgtctgtgccgaggtgcagctggtgcagtctggagcagaggtgaaaaagcccggggagtctctgaagatctcctgtaagggttttggatacaactttaccatctactggatcgcctgggtgcgccagatgcccgggaaaggcctagagtgggtgggaatcgtctatcctgacgactctgataccagatacagcccgtccttccaaggccaggtcaccatctcagccgacaagtccgtcaataccgcctacctgcagtggagcagtctgcaggcctcggacaccgccatgtacttctgtgcgagagggttcggggatgactactggggccagggaaccctggtcaccgtctcttcagcttccaccaagggcccatcggtcttcccctggcgccctgctccaggagcacctctgggggcacagcggccctgggctgcctggtcaaggactacttccagtcgctaga

SEQ ID NO: 457860 - DNA, 514 bp, Homo sapiens
  misc_feature: HEFZJCU01EP0SE.51.5.A05.1.454.heavy.3.raw
cgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtcctgcacctcgtgtggccccaatttggtttaccggcacacaaaatcagggcaagtcctacgacggtctggtacg

SEQ ID NO: 457861 - DNA, 491 bp, Homo sapiens; identical to SEQ ID NO: 444749
  misc_feature: HEFZJCU01BXCL7.11.13.B02.1.454.heavy.3.raw

SEQ ID NO: 457862 - DNA, 528 bp, Homo sapiens
  misc_feature: HEFZJCU01DVV01.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactccctgtacagcctctggattcactttcagtaaggcctggatgaactgggtccgccaggctccagggaaggggctggagtgggttggccgtattaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatcccctgaaagcgtcaactactactactacgtatggactcg

SEQ ID NO: 457863 - DNA, 509 bp, Homo sapiens
  misc_feature: HEFZJCU01EO7W1.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctgggggcacagcggccctgggctgactggtcaaggactacttcctacgtcgtat

SEQ ID NO: 457864 - DNA, 525 bp, Homo sapiens
  misc_feature: HEFZJCU01CHZ19.12.40.D07.1.454.heavy.3.raw
  modified_base (472)..(472): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagaggacacacgaacctactggccaatactatgggggcttgttctgggggccaggggacccnggtcatcgtctccccagcctccaccaagggcccatcggtcttcccctcggtcg

SEQ ID NO: 457865 - DNA, 500 bp, Homo sapiens
  misc_feature: HEFZJCU01A7XRE.13.85.H08.1.454.heavy.3.raw
tcacgtactacacgaccggtgctcgatttagtatcactcagtcgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagttgagcagcctgagatctgacgacacggccgttttatactgtgcgcgagataatagtcacaactggaacggcgttttggggtggttc

SEQ ID NO: 457866 - DNA, 496 bp, Homo sapiens; identical to SEQ ID NO: 454802
  misc_feature: HEFZJCU01DKEFQ.51.64.F09.1.454.heavy.3.raw

SEQ ID NO: 457867 - DNA, 526 bp, Homo sapiens
  misc_feature: HEFZJCU01AUH6A.15.34.D01.1.454.heavy.3.raw
tctacgtagccacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagggtgaggtgcaggtggtggaatctgggggaggcttggtccagcctggggggtccctgagactctcctgtgcagcctctggattcagttctagtaaatactggataagttgggtccgccaggctccagggaaggggctggagtggatggccaatatgaaccaagacggaagtgataaacatcatgtgggctctgtgcagggccgattcactatctccagagacaacgccaagaatctagtgtatttgcaaatgaacagcctgagagccgacgacacggctgtgtattactgtgcgggagggccggagtggtatttggattactttctggggccagggggtacccg

SEQ ID NO: 457868 - DNA, 471 bp, Homo sapiens
  misc_feature: HEFZJCU01AO13P.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 457869 - DNA, 502 bp, Homo sapiens; identical to SEQ ID NO: 454914
  misc_feature: HEFZJCU01BX4N5.4.58.F03.1.454.heavy.3.raw

SEQ ID NO: 457870 - DNA, 523 bp, Homo sapiens
  misc_feature: HEFZJCU01EVZ4M.12.40.D07.1.454.heavy.3.raw
  modified_base (376)..(376): a, c, t, g, unknown or other
atacgacgtacacgaccggtgctcgatttagtgatagagcgtaacaacagagggctcaccatggagtttgggctgagcgtggtttcgtcgttaggcgtctttaagtaggtgtcagtgtcaggggcacctggtggagtctgggggagccgtggtccagcctgggcggtccctgacactcgcctgtgttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctnagaccagacgacacggctgtctattattgcgcgagagagacacacgaacctactggccaatactatgggggcttgttctggggccaggggaccctgggcatcgtctccccagcctccaccaagggcccatcggtcttccccctggcg

SEQ ID NO: 457871 - DNA, 519 bp, Homo sapiens
  misc_feature: HEFZJCU01ATDZF.15.16.B05.1.454.heavy.3.raw
tctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccaggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccaggggaaccctggtctacccg

SEQ ID NO: 457872 - DNA, 464 bp, Homo sapiens; identical to SEQ ID NO: 445062
  misc_feature: HEFZJCU01AT2IK.19.10.A10.1.454.heavy.3.raw

SEQ ID NO: 457873 - DNA, 503 bp, Homo sapiens; identical to SEQ ID NO: 456214
  misc_feature: HEFZJCU01CNHWV.16.21.B10.1.454.heavy.3.raw

SEQ ID NO: 457874 - DNA, 499 bp, Homo sapiens
  misc_feature: HEFZJCU01C3SPX.48.61.F06.1.454.heavy.3.raw
agtatacatacacgaccggtgctcgatttagctacgctctaagggaaaggggctctgggagacgagcccagcactggaagtcgccggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcttgtgcagcctctggattcattttcagtgactatggtatgcactgggtccgccaggctccaggcaaggggctggagtgggtggcagtcataccttctgctggaaggaatatctactacgcgggctccgtgaagggccgattcaccatctccagagacaattccaacaagacactgtatctgcaaatgaacagcctgagggctgaagacacggctgtgtattactgtgcgagaggctatcactatgggtttc

SEQ ID NO: 457875 - DNA, 524 bp, Homo sapiens
  misc_feature: HEFZJCU01DUQYJ.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcagggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaactgaccgctgtgaccgccgcggacacggctgtgtattactgtgcgagacgaatgggcgggtggctacgacttgacttttggggccagggaaacctggtcaccgtctccccagcttccaccaaggcccatcggtcttccccg

SEQ ID NO: 457876 - DNA, 530 bp, Homo sapiens
  misc_feature: HEFZJCU01ARJOV.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactacgtgggggccggggagccccggtcatcgtctccc

SEQ ID NO: 457877 - DNA, 513 bp, Homo sapiens; identical to SEQ ID NO: 446699
  misc_feature: HEFZJCU01BACAX.12.25.C03.1.454.heavy.3.raw

SEQ ID NO: 457878 - DNA, 525 bp, Homo sapiens
  misc_feature: HEFZJCU01DMQKN.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgagggccgattcaccatctccagagacaattccaagaacacgctgtttcttcaaatgaacagcctgagagccgatgaacacggccgtgtattactgtgcgagagagtggggcccacgtaacgttacctacgctatcggacgtcgtggggccaagggacccg

SEQ ID NO: 457879 - DNA, 411 bp, Homo sapiens; identical to SEQ ID NO: 445580
  misc_feature: HEFZJCU01D9UM8.51.31.C09.1.454.heavy.3.raw

SEQ ID NO: 457880 - DNA, 516 bp, Homo sapiens
  misc_feature: HEFZJCU01BHX8F.51.26.C04.1.454.heavy.3.raw
cgatcgtatacacgaccggtgctcgatttagtctagcgactttgggtttgggggctctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggt

SEQ ID NO: 457881 - DNA, 491 bp, Homo sapiens; identical to SEQ ID NO: 444592
  misc_feature: HEFZJCU01A73US.11.26.C04.1.454.heavy.3.raw

SEQ ID NO: 457882 - DNA, 482 bp, Homo sapiens
  misc_feature: HEFZJCU01DKSNF.7.10.A10.1.454.heavy.3.raw
cgtgtctctacacgaccggtgctcgatttagcgtcgatctcagaggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggactacttcctagagacacg

SEQ ID NO: 457883 - DNA, 515 bp, Homo sapiens
  misc_feature: HEFZJCU01BIRFW.10.53.E09.1.454.heavy.3.raw
catagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgttctgcaatgaacagcctgagagctgaggacacggctgtgtattactgttcgtttggttctgactcgtcgggggataccttcagcactggggccgac

SEQ ID NO: 457884 - DNA, 502 bp, Homo sapiens
  misc_feature: HEFZJCU01CBNA5.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacgggccgtgtattactgtgcgagactggccgcaacagactacggtggcaactcctatgcttttgatatctggggccaaggggac

SEQ ID NO: 457885 - DNA, 486 bp, Homo sapiens; identical to SEQ ID NO: 444861
  misc_feature: HEFZJCU01D1RE7.47.55.E11.1.454.heavy.3.raw

SEQ ID NO: 457886 - DNA, 424 bp, Homo sapiens
  misc_feature: HEFZJCU01C5DFP.9.34.D01.1.454.heavy.3.raw
tgatacgtctcacgaccggtgctcgatttagatcgtctgtgttgggtttgggattcacgttgcagatgtaggtctgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgatttcgatccctccgcagtcgacactttgattactggggccggggaaccctggtcgccgtctcctcagcctccaccaagggcccatcggtcttcccctggcaccctcctccaagagcacctctggggcacagcggccctgggctgcctggtcaaggactacttccagacgtatca

SEQ ID NO: 457887 - DNA, 505 bp, Homo sapiens
  misc_feature: HEFZJCU01ADZNA.48.49.E05.1.454.heavy.3.raw
  modified_base (329)..(329): a, c, t, g, unknown or other
agtatacatacacgaccggtgctcgatttagagcgactagcaacacacaaaggggaggtctcagagaggagccttagccctggactccaaggcctttccacttggtgatcagcactgagcacagaggactcaccatggaattggggctgagcgtggtttcgtgttaggcgtattttagtaaggtgtccagtgtgaggtgcagctggtggagtctgggggaggcttggtccagccgggggggtccctgagactctcctgtgcagcctctggactcacctttagtacctattggatgacctgggtccgccaatctccagggaggggctggngtgggtggccaacataaagggagatggaagtaagacatactatgcggattctgtgaagggccgattcaccatctccagagacaacgccaaggagtcactgtatctgcagatgaacagcctgagagccgaggacgcggctgtggtattactgtgcgagagatgtagaatcccttttg

SEQ ID NO: 457888 - DNA, 527 bp, Homo sapiens
  misc_feature: HEFZJCU01C1TZ1.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctcggcgccctgctccaggagcacctccgacgagcacagcggcccgtcgggtcg

SEQ ID NO: 457889 - DNA, 482 bp, Homo sapiens; identical to SEQ ID NO: 444503
  misc_feature: HEFZJCU01BIZN2.7.10.A10.1.454.heavy.3.raw

SEQ ID NO: 457890 - DNA, 491 bp, Homo sapiens; identical to SEQ ID NO: 445899
  misc_feature: HEFZJCU01CAMNO.11.26.C04.1.454.heavy.3.raw

SEQ ID NO: 457891 - DNA, 520 bp, Homo sapiens
  misc_feature: HEFZJCU01CURG5.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaagggcccatcggtcttcccctggcgccctgctccaggagcacctcgtgggggcacgacgcggcccgtcgggctgcctcggtcaaggactaccttcccactacc

SEQ ID NO: 457892 - DNA, 486 bp, Homo sapiens; identical to SEQ ID NO: 454595
  misc_feature: HEFZJCU01B9RQC.16.12.B01.1.454.heavy.3.raw

SEQ ID NO: 457893 - DNA, 506 bp, Homo sapiens
  misc_feature: HEFZJCU01A0K0K.48.81.H04.1.454.heavy.3.raw
agtatacatacacgaccggtgctcgatttagtagtgtagattcgcggggagcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggagttatcatctactacttt

SEQ ID NO: 457894 - DNA, 506 bp, Homo sapiens
  misc_feature: HEFZJCU01EQ8PM.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaa

SEQ ID NO: 457895 - DNA, 531 bp, Homo sapiens
  misc_feature: HEFZJCU01DLUIM.13.62.F07.1.454.heavy.3.raw
tcacgtactacacgaccggtgctcgatttagtagtcgcataaagggaaagggtctgtgcaggcttcagcagtcctggacctcccgtgcaagaacatgaaacacctgtggttcttcctcctgctggtgtcagctcccagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtcgtattactgttgcgcgaggatctccgtcggacacttcgtgacaaggcaaaacgtccgaaagtcgttatcactttgactcctgggccagggaaccctgg

SEQ ID NO: 457896 - DNA, 520 bp, Homo sapiens
  misc_feature: HEFZJCU01C7TIX.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctctttttatttatagtagtggtagtacatactccgcagactccgtgagggccgattcaccatctccagagacaattccaagaacacgctgtttcttcaaatgaacagcctgagagccgatgacacggccgtgtattactgtgcgagagatggggcccacgaacgttactacgctatggacgtcgtggggccaagggaccg

SEQ ID NO: 457897 - DNA, 510 bp, Homo sapiens
  misc_feature: HEFZJCU01ASB6B.48.57.F02.1.454.heavy.3.raw
agtatacatacacgaccggtgctcgatttagctcgatatagttgggtttggggggtctcagagaggagccttagccctggactccaaggcctttccacttggtgatcagcactgagcacagaggactcaccatggaattggggctgagctgggttttccttgttgctattttagaaggtgtccagtgtgaagtgcagctggtggagtctgggggaggcttggtccagcctggggggtccctaagactctcctgtgcagcctctggattcacctttagtacctattggatgacctggatgaacagcctgagagccgaggacgcggctgtgtattactgtgcgagagatgcgaatccctctgatagtaatggtcgttattatgatgcttttgatatgtggggccaagggacaacggtcaccgtctcttcagcctccaccaagggcccatcggtcttcccctggcgccctgctccaggagcacctccgagagcacagcggccctgggctgccg

SEQ ID NO: 457898 - DNA, 532 bp, Homo sapiens
  misc_feature: HEFZJCU01DTPYN.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaaggggccgtttcaccatctccagagacaacgccaagaattcactgtatctacaactgaacagcctgagagtcgcagacacggccgtgtattactgtgcgagatgtggaaaagtaatggctgtgtttattggggccagggagccctggtcaccgt

SEQ ID NO: 457899 - DNA, 509 bp, Homo sapiens; identical to SEQ ID NO: 444586
  misc_feature: HEFZJCU01APUWL.12.78.H01.1.454.heavy.3.raw

SEQ ID NO: 457900 - DNA, 508 bp, Homo sapiens; identical to SEQ ID NO: 452449
  misc_feature: HEFZJCU01EK0MF.11.13.B02.1.454.heavy.3.raw

SEQ ID NO: 457901 - DNA, 531 bp, Homo sapiens
  misc_feature: HEFZJCU01AMEMW.52.34.D01.1.454.heavy.3.raw
cgcagtacgacacgaccggtgctcgatttagatcgtctgtgttgggtttgggggctctgagagaggagcccagccctgggattttcaggtgttttcatttggtgatcaggactgaacagagagaactcaccatggagtttgggctgagctggctttttcttgtggctattttaaaaggtgtccagtgtgaggtgcaactgttggagtctgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgccccttggactggttatttcgactcctgggccac

SEQ ID NO: 457902 - DNA, 509 bp, Homo sapiens
  misc_feature: HEFZJCU01CG9H6.10.5.A05.1.454.heavy.3.raw
catagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccgggggagtctgtgaagatctcttgcacgggttcaggagacagatttagcagcgactggctcggctggttgcgccagatgcccggggaaggcctggagtggatggggatcatcaatcttggtagctctgaaaccagatacaccccgtccttccaaggccgggtcaccatctcagccgacaggtccatcagtactacctacttggagtggattagctgaaggcctcggacaccgccatgtattactgtacgagacttgaacggggattctattatggcgcgatcgtggggccagggaaccctggtcaccg

SEQ ID NO: 457903 - DNA, 507 bp, Homo sapiens
  misc_feature: HEFZJCU01D176V.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtacttac

SEQ ID NO: 457904 - DNA, 400 bp, Homo sapiens; identical to SEQ ID NO: 444452
  misc_feature: HEFZJCU01DS6C7.47.24.C02.1.454.heavy.3.raw

SEQ ID NO: 457905 - DNA, 506 bp, Homo sapiens; identical to SEQ ID NO: 444713
  misc_feature: HEFZJCU01AEIXD.5.41.D08.1.454.heavy.3.raw

SEQ ID NO: 457906 - DNA, 449 bp, Homo sapiens
  misc_feature: HEFZJCU01C4MMB.53.57.F02.1.454.heavy.3.raw
cgcgtatacacacgaccggtgctcgatttagctcgatatagttgggtttgggctcggggctgccctttggctttggagatggttttctcgatgggggctggagtgggtggcagttatatcaaatgatggaagtaagaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaagggcccatcggtcttcccctggcaccctcctccaagagcacctctgggggcacagcggccctgggctgcctggtcaaggactacttcctcgtactgcg

SEQ ID NO: 457907 - DNA, 483 bp, Homo sapiens; identical to SEQ ID NO: 444932
  misc_feature: HEFZJCU01C3WJX.7.10.A10.1.454.heavy.3.raw

SEQ ID NO: 457908 - DNA, 510 bp, Homo sapiens
  misc_feature: HEFZJCU01BX8YF.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctaatggcagtgttataaattatgcggactccgtgaggggccgattcagcatctccagagacaacggcaagagtatactgtatctggaatgaacaatctgagagtcgacgatacggctgtctatcattgtgttttcgatgccttcggtccgcgggacttctggggccagggaaccct

SEQ ID NO: 457909 - DNA, 510 bp, Homo sapiens; identical to SEQ ID NO: 447226
  misc_feature: HEFZJCU01BNZ4O.12.78.H01.1.454.heavy.3.raw

SEQ ID NO: 457910 - DNA, 539 bp, Homo sapiens
  misc_feature: HEFZJCU01D87OU.13.57.F02.1.454.heavy.3.raw
  modified_base (463)..(463): a, c, t, g, unknown or other
tcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttgggtccgccagcccccagggaaggggctggagtggattggggaaatctttcatagcgggatcaccaactacaacccgtccctcaagagtcgagtcaccatatctatagacaagtccaagaaccacttctccctgaacgtgagttctgtgaccgccgcggacacggccgtgtattactgtgcgagaggattgtggttttacnctggttcaatgagttattatgttctttgactagttggggccagggaaccctggtcaccgtctcctcagcctccacc

SEQ ID NO: 457911 - DNA, 490 bp, Homo sapiens; identical to SEQ ID NO: 446494
  misc_feature: HEFZJCU01EXZ6P.11.13.B02.1.454.heavy.3.raw

SEQ ID NO: 457912 - DNA, 501 bp, Homo sapiens
  misc_feature: HEFZJCU01C6XTG.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaatgatagaaatcagggatgggggccagggaaccctggtcaccgtctcctcagcctccaccaagggcccatcggtccttcccctggcgccctgctccaggagcacctccgagagcacagcggccctgggctgcctggtcaaggactacttccga

SEQ ID NO: 457913 - DNA, 497 bp, Homo sapiens; identical to SEQ ID NO: 450948
  misc_feature: HEFZJCU01B76FG.53.80.H03.1.454.heavy.3.raw

SEQ ID NO: 457914 - DNA, 517 bp, Homo sapiens
  misc_feature: HEFZJCU01B933D.48.34.D01.1.454.heavy.3.raw
agtatacatacacgaccggtgctcgatttagatcgtctgtgttgggtggggttggtggagtcggggggaggtgtggtccagcctgggaagtccctgacactgtcctgcgcagcctctggattcaccttcaccacctttcgtatgcactttgtccgccaggctccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaacgtggggccagggaaccctggtcaccgtctcctcagcctccaccaagggccc

SEQ ID NO: 457915 - DNA, 507 bp, Homo sapiens
  misc_feature: HEFZJCU01DWYYI.48.44.D11.1.454.heavy.3.raw
agtatacatacacgaccggtgctcgatttagcgcagtacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctcccgagagcacagcggccctgggctgcctggtcaaggactacttcctatgtatact

SEQ ID NO: 457916 - DNA, 501 bp, Homo sapiens
  misc_feature: HEFZJCU01C4KRZ.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacaacagtctacatgcaactgacgagcctgagagctgacgacacggccgtctattactgtgcgagaatgttttctgccatcgtacaatttgataggctctatggactggacttct

SEQ ID NO: 457917 - DNA, 501 bp, Homo sapiens
  misc_feature: HEFZJCU01AHEZD.52.46.E02.1.454.heavy.3.raw
  modified_base (362)..(362): a, c, t, g, unknown or other
cgcagtacgacacgaccggtgctcgatttagactcatctacagggaaagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctggggggggctggtccagcctgggaggtccctgagactctcctgtgcaggctctgcatttcccttcagtaactatgctatcgattgggtccgccaggctccaggcgggggactggagtgggtggcagttatatcagctgatggaggccttaaatnttacgcagattctgcgagggccgattcaccatatccagagacaactacccaagatatgatatatctacaaatgaacagcctgagacctgaggacacggctagtatattattgtgcgtcgagggggcagtgcctggaccg

SEQ ID NO: 457918 - DNA, 490 bp, Homo sapiens
  misc_feature: HEFZJCU01DRN5E.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctctcagcctccaccaagggcccatcggtcttcccctggcgcctgctccaggagccacctccgagagcacagcggccctgggctgcctggtcaaggactacttccgtatctctcg

SEQ ID NO: 457919 - DNA, 486 bp, Homo sapiens; identical to SEQ ID NO: 448316
  misc_feature: HEFZJCU01DENUW.3.48.E04.1.454.heavy.3.raw

SEQ ID NO: 457920 - DNA, 498 bp, Homo sapiens
  misc_feature: HEFZJCU01AU9OD.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgatctgcaaatgacagcctgagagccgaggacacggggtgtttattaacgtgttaggggagtaaagtcctagt

SEQ ID NO: 457921 - DNA, 496 bp, Homo sapiens
  misc_feature: HEFZJCU01AHK0G.13.10.A10.1.454.heavy.3.raw
  modified_base (474)..(474): a, c, t, g, unknown or other
tcacgtactacacgaccggtgctcgatttagcgtcgatctcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagttggaagtgagaaatactatgtggactctgtgaagggccgattcaccatctccagagacaacgccaagaactcactgtatctgcaaatgaacagcctgagagccgaggacacggctgtctattactgtgcgagngattggggcggaaggtatagca

SEQ ID NO: 457922 - DNA, 531 bp, Homo sapiens
  misc_feature: HEFZJCU01B262H.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttggttctgggggccaggggaccctgggtcatcgtctccccagcctccaccaagggcccatcggtcttcccctggcgcccgtcg

SEQ ID NO: 457923 - DNA, 484 bp, Homo sapiens
  misc_feature: HEFZJCU01AQ2FE.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggtggccgttattaggaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccaggggagcccttgtcaccgtctcctcagcctccaccaagggcccatcggtcttcccctggcgccctgctccaggagcacctccgagagcacagcggccctgggctgcctggcaaggactacttcccactactatg

SEQ ID NO: 457924 - DNA, 490 bp, Homo sapiens
  misc_feature: HEFZJCU01AXKWR.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcattgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggcctgggctgcctggtcaaggactacttcccacgagagta

SEQ ID NO: 457925 - DNA, 517 bp, Homo sapiens
  misc_feature: HEFZJCU01C084B.5.78.H01.1.454.heavy.3.raw
atcagacacgcacgaccggtgctcgatttagtgtgagtagtttgggtttgggggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagctatgactccgtgaagggccgattcaccatctccagagacaattccaagaacactctgtatctgcaaatggacagcctgagacctgaggacacggctgtgtattactgtgcgaaagaaaccggcgggcagtggctgggcccatttgaccactggggccagggaaccctggtcaccgtctcctcagcctccaccaagggcccatcggtcttcccctggcaccctcctccaagagcacctctgggggcacagcggccctgggctgcctggtcaaggactacttcccg

SEQ ID NO: 457926 - DNA, 509 bp, Homo sapiens; identical to SEQ ID NO: 445824
  misc_feature: HEFZJCU01EG212.9.14.B03.1.454.heavy.3.raw

SEQ ID NO: 457927 - DNA, 491 bp, Homo sapiens; identical to SEQ ID NO: 447648
  misc_feature: HEFZJCU01BT9VZ.10.34.D01.1.454.heavy.3.raw

SEQ ID NO: 457928 - DNA, 507 bp, Homo sapiens
  misc_feature: HEFZJCU01B1CYK.52.83.H06.1.454.heavy.3.raw
  modified_base (456)..(456): a, c, t, g, unknown or other
cgcagtacgacacgaccggtgctcgatttagatcacgtgcgtcgcgggggggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttatatcaaatgatggaagtaacaaatactatgtagactccgtgaagggccgattcaccatctccagagacaattccaagaatacgctgtatctgcacatgaacagcctgagagccgaagacacgggtntttatactgtgcgaacttatacggagacaacggtaaccccgtcgcacggcg

SEQ ID NO: 457929 - DNA, 507 bp, Homo sapiens
  misc_feature: HEFZJCU01BNDAV.8.39.D06.1.454.heavy.3.raw
ctcgcgtgtccacgaccggtgctcgatttagtgacatctcgcagttctttgggttttggggggaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtcgtccatgaccagtgacacgtccgcgagcactgtctatatggagatgaggagcctgagacttgacgacacggccgtatattactgtgcgagaatcgaagaaggtggctacaatcacggagcttttgaagttttggggcctaagggacaatggtcatcgtctcctcagcctcaccaaggccatcggtcttcccctgg

SEQ ID NO: 457930 - DNA, 531 bp, Homo sapiens
  misc_feature: HEFZJCU01EU3JD.16.87.H10.1.454.heavy.3.raw
tgtactactccacgaccggtgctcgatttagcagtactgcgttgggtttgggggccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaagggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatgggttggggggagttggggtttttttttcgttactacgggatc

SEQ ID NO: 457931 - DNA, 491 bp, Homo sapiens
  misc_feature: HEFZJCU01C0M3Y.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaatgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggactacttccgagtgcgtct

SEQ ID NO: 457932 - DNA, 499 bp, Homo sapiens
  misc_feature: HEFZJCU01DBH71.3.20.B09.1.454.heavy.3.raw
  modified_base (453)..(453): a, c, t, g, unknown or other
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacngactacggtggcaactcctatgctttgatatctggggccaagggac

SEQ ID NO: 457933 - DNA, 395 bp, Homo sapiens; identical to SEQ ID NO: 444517
  misc_feature: HEFZJCU01EHBQG.16.68.G02.1.454.heavy.3.raw

SEQ ID NO: 457934 - DNA, 491 bp, Homo sapiens
  misc_feature: HEFZJCU01CBFR1.11.71.G05.1.454.heavy.3.raw
  modified_base (485)..(485): a, c, t, g, unknown or other
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagntttcat

SEQ ID NO: 457935 - DNA, 500 bp, Homo sapiens
  misc_feature: HEFZJCU01EEFBS.3.71.G05.1.454.heavy.3.raw
agacgcactccacgaccggtgctcgatttagtgtcgtcgcaagagagagggggcgtgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgtgtaaagtcccggggaaatatgtacg

SEQ ID NO: 457936 - DNA, 470 bp, Homo sapiens; identical to SEQ ID NO: 445307
  misc_feature: HEFZJCU01AEZIO.12.78.H01.1.454.heavy.3.raw

SEQ ID NO: 457937 - DNA, 519 bp, Homo sapiens
  misc_feature: HEFZJCU01CKHF7.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaaggcccatcggtcttcccctggccaccctcctccaagagcacctctgggggcacagcggccctgggctgcctggtcaaggactacttcctagagacacg

SEQ ID NO: 457938 - DNA, 502 bp, Homo sapiens
  misc_feature: HEFZJCU01EPKAU.40.81.H04.1.454.heavy.3.raw
tctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccggcggggctgaccacgtggggcccg

SEQ ID NO: 457939 - DNA, 520 bp, Homo sapiens
  misc_feature: HEFZJCU01C1ROM.14.35.D02.1.454.heavy.3.raw
cgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactgggccagggaaccctggtcaccgtctcctcagcctccaccaagggcccatcggtcttccccctggcaccctcctccaagagcacctctgggggcacagcggcctgggctgcctggtcaaggact

SEQ ID NO: 457940 - DNA, 525 bp, Homo sapiens
  misc_feature: HEFZJCU01B5LMK.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccagagcacctccgagagcacagcggccctgggctgcctggtcaaggactactccacg

SEQ ID NO: 457941 - DNA, 508 bp, Homo sapiens
  misc_feature: HEFZJCU01CHEU7.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccaggggcagagtcaccatgaccgggaacccctccaccggcacagcctacatggagctgagcagtctgacacctgacgacacggccgtctattactgtgcgagagccgcgaatatgtggtgcaaagatggtcgttgtttgtttggccggtgaactactggggccagggcaccctggtcaccgtctcctcagcttccaccaagggcccatcggtcttcccctggcgccctgctccaggagcacctctggggcacagcggccctgggctgcctggtcaggactactcccact

SEQ ID NO: 457942 - DNA, 517 bp, Homo sapiens; identical to SEQ ID NO: 444897
  misc_feature: HEFZJCU01EN2CZ.9.34.D01.1.454.heavy.3.raw

SEQ ID NO: 457943 - DNA, 484 bp, Homo sapiens; identical to SEQ ID NO: 446564
  misc_feature: HEFZJCU01D3PED.19.13.B02.1.454.heavy.3.raw

SEQ ID NO: 457944 - DNA, 515 bp, Homo sapiens
  misc_feature: HEFZJCU01CJJC8.48.35.D02.1.454.heavy.3.raw
agtatacatacacgaccggtgctcgatttagcacacgatagttgggtttgggggctttctgagagtcatggatctcatgtgcaagaaaatgaagcacctgtggttcttcctcctgctggtggcggctcccagatgggtcctgtcccagctgtttctgcaggagtcgggcccaggactggtgaagccttcggagaccctatccctcacctgcactgtctctggtgtctccgtcagcagtaacacttattactgggcctggatccgccagccccccgggaagggactggaatggattgggagtatctattatacagggagcacctactacaacccgtccctcaagagtcgagtcaccatctccgcagacacgtccaagaaccagttctccctgaggctgagctctgtgaccgccgcagacacggctgtctattactgtgcgagaagtgggtctggcagtggctggtacgtggctctcagtggttcgacccctggggccagggactacctggtcaccg

SEQ ID NO: 457945 - DNA, 509 bp, Homo sapiens
  misc_feature: HEFZJCU01A4MDA.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttgagctgaacagcctaagtcctgaggacacgggcgtatactactgtacgaaggaggggggaaccagcgggagttccaagtactcctttg

SEQ ID NO: 457946 - DNA, 514 bp, Homo sapiens
  misc_feature: HEFZJCU01B9KRQ.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttcagtaactacggcatgcactgggtccgccaagctccaggcaagggattggagtgggtgcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggaggggggaaccgagcgggagttccaagtactcctttgtacg

SEQ ID NO: 457947 - DNA, 485 bp, Homo sapiens
  misc_feature: HEFZJCU01DQFJ0.18.70.G04.1.454.heavy.3.raw
  modified_base (425)..(425): a, c, t, g, unknown or other
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccngagcacctctggggcacagcgccctggctgcctggtcaaggactacttcccatactcgta

SEQ ID NO: 457948 - DNA, 487 bp, Homo sapiens; identical to SEQ ID NO: 454270
  misc_feature: HEFZJCU01DMA01.3.48.E04.1.454.heavy.3.raw

SEQ ID NO: 457949 - DNA, 521 bp, Homo sapiens; identical to SEQ ID NO: 451537
  misc_feature: HEFZJCU01A8J92.13.76.G10.1.454.heavy.3.raw

SEQ ID NO: 457950 - DNA, 483 bp, Homo sapiens
  misc_feature: HEFZJCU01BBS91.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggcgccctgctccaggagcacctcccgagagcacagcggccctgggctgcctggtcaaggactacttccacgccgtatgt

SEQ ID NO: 457951 - DNA, 498 bp, Homo sapiens; identical to SEQ ID NO: 449824
  misc_feature: HEFZJCU01A9IWU.47.38.D05.1.454.heavy.3.raw

SEQ ID NO: 457952 - DNA, 502 bp, Homo sapiens; identical to SEQ ID NO: 445804
  misc_feature: HEFZJCU01C86Q3.10.38.D05.1.454.heavy.3.raw

SEQ ID NO: 457953 - DNA, 481 bp, Homo sapiens
  misc_feature: HEFZJCU01DJKZ4.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaacgggcccatcggtccttccccctggccaccctcctccaagagcacctcgtggggcacgagccggccctgggctgcctggtcaggactacttccgagtagtaca

SEQ ID NO: 457954 - DNA, 499 bp, Homo sapiens
  misc_feature: HEFZJCU01EM7KL.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgaccctggggccagggaaccctggtcgtcgtctcgtctgcctccaccaagggcccatcggtcttcccctggcgccctgctccaggagcacctccgagagcacagcggccctgggctgcctggtcaaggactacttcctagtacgtga

SEQ ID NO: 457955 - DNA, 516 bp, Homo sapiens
  misc_feature: HEFZJCU01ASA1Z.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctgggtggacagatcacgtggggccaac

SEQ ID NO: 457956 - DNA, 532 bp, Homo sapiens
  misc_feature: HEFZJCU01BMBN5.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagcgtgcgttttcttagtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaagggctggagtgggtctctactattactgctagtggtaatcatgcatactatgcagactccgtgaagggccggttcaccttcaccagagacaattccaagaacacgctctatctgcaattgaccagcctgagcgccgaggacacgggccatgtattactgtactaaatcgcgggtggccgcggccggtacctcggatgggttttgattttcctggggccaaggggacg

SEQ ID NO: 457957 - DNA, 496 bp, Homo sapiens
  misc_feature: HEFZJCU01DQTAM.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggcctgggctgcctggtcaaggactacttccgagtagtaca

SEQ ID NO: 457958 - DNA, 495 bp, Homo sapiens
  misc_feature: HEFZJCU01CZAEQ.52.34.D01.1.454.heavy.3.raw
cgcagtacgacacgaccggtgctcgatttagatcgtctgtgttgggtttgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcggagcagccccgtaacttctggggccagggaacccgggtcaccgtctcctcagcctccaccaagggcccatcggtcttccccctggcaccctcctccaagagcacctctgggggcacagcggccctgggctgcctggtcaaggactacttccctatacgatcg

SEQ ID NO: 457959 - DNA, 516 bp, Homo sapiens; identical to SEQ ID NO: 445176
  misc_feature: HEFZJCU01AM40E.14.66.F11.1.454.heavy.3.raw

SEQ ID NO: 457960 - DNA, 510 bp, Homo sapiens; identical to SEQ ID NO: 457102
  misc_feature: HEFZJCU01CY4IL.18.39.D06.1.454.heavy.3.raw

SEQ ID NO: 457961 - DNA, 518 bp, Homo sapiens
  misc_feature: HEFZJCU01ESPZV.17.25.C03.1.454.heavy.3.raw
cgtagactagcacgaccggtgctcgatttagtagtgtagatttgggtttggggaaccacactctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagactttaccatggaccacgaactcctccataaacacagcctacatggagttgaggagcctgacatctgacgacacggccgtctattactgtgcgagacgttcccacgatccggtgagcctacggcagcgcctttgactttcgtggggtcccaggggaccg

SEQ ID NO: 457962 - DNA, 507 bp, Homo sapiens
  misc_feature: HEFZJCU01BWVQD.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgcttctggggccagggacg

SEQ ID NO: 457963 - DNA, 378 bp, Homo sapiens; identical to SEQ ID NO: 448904
  misc_feature: HEFZJCU01DHRLV.4.29.C07.1.454.heavy.3.raw

SEQ ID NO: 457964 - DNA, 400 bp, Homo sapiens; identical to SEQ ID NO: 444452
  misc_feature: HEFZJCU01CW7D0.47.24.C02.1.454.heavy.3.raw

SEQ ID NO: 457965 - DNA, 503 bp, Homo sapiens
  misc_feature: HEFZJCU01DH94A.49.21.B10.1.454.heavy.3.raw
agtcgagagacacgaccggtgctcgatttagtgtcgtcgcaaggggctgggagacgagcccagcactggaaggcgccggtgtttccattcggtgatcagcactgaacacagaggactcaccatggagtttgggctgagctgggttttcctcgttggtcttttaagaggtgtccagtgttatgtgcagttggtggagtctgggggaggcgtggtccagcctgggaagtcactgagactcgcctgtacaccctctggattcaccttcagcaactatgcaatgcactgggtccgcctggctcccggcaagggtctggactgggtggcaggtatatcagctgatgggaccaaaatatactacgcaaactccgtgaagggccgattcaccatatcaagagacacttccgatgacacaatctatctgcaaatgaaacagcctagaaagttgacgacacgggtctttttactgtgcgcctggaagcagtggctggccacatgatgctttt

SEQ ID NO: 457966 - DNA, 324 bp, Homo sapiens
  misc_feature: HEFZJCU01D74EA.18.17.B06.1.454.heavy.3.raw
tacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcttccaccaagggcccatcggtcttccccctggcgccctgctccaggagcacctctgggggcacagcggccctgggctgcctggtcaaggactacttcccatactcgta

SEQ ID NO: 457967 - DNA, 505 bp, Homo sapiens
  misc_feature: HEFZJCU01E049U.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctgggccagggagcccaggtcaccgtctccccacgcctccaccaagggcccatcggtcttccccctggcgccctcgctccaggagcacctccgagagcacagcggcctgggctgcctggtcaaggactactcccactacta

SEQ ID NO: 457968 - DNA, 521 bp, Homo sapiens
  misc_feature: HEFZJCU01DIGKW.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgatttcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccagggcccatcggtcttcccctggcg

SEQ ID NO: 457969 - DNA, 499 bp, Homo sapiens
  misc_feature: HEFZJCU01BATGZ.26.23.C01.1.454.heavy.3.raw
agactatactcacgaccggtgctcgatttagtacacgtgattagggattgggaggcgtggtccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatctccagagacgtttccgagaacacattaaatctggaataaacttcgtgagaagtgacgactcggccgtttattttgtgcgagagaggggtacagtagcggccgagctccggcctttgaccactggggccagggaaccctggtcaccgtctcctcagcctccaccaagggcccatcggtcttcccctggcgccctgctccaggagcacctccgagagcacagcggccctgggctgcctggtcaaggactacttccagtatagtct

SEQ ID NO: 457970 - DNA, 510 bp, Homo sapiens
  misc_feature: HEFZJCU01CCNNM.13.55.E11.1.454.heavy.3.raw
tcacgtactacacgaccggtgctcgatttagcactcgcacgttgggtttggggagctctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctgggggaggtttggtacagccagggcggtccctgagactctcctgtataacttctggattcaacttgggtgattatgctatgaactgggtccgccaggctccagggaagggctgggagtgggtaggtttcattaggagcaattctcatgatgggacaacagaatacgccgcgtctgtaaaaggcagattcaccatctcaagagatgagtccagaagcatcgcctttctgcagatgagtagcctgaagaccgaggacacgagccatctattactgtgctagagagtattgcagtcctacga

SEQ ID NO: 457971 - DNA, 510 bp, Homo sapiens; identical to SEQ ID NO: 445542
  misc_feature: HEFZJCU01D2A6P.16.21.B10.1.454.heavy.3.raw

SEQ ID NO: 457972 - DNA, 504 bp, Homo sapiens; identical to SEQ ID NO: 455206
  misc_feature: HEFZJCU01BNQET.47.81.H04.1.454.heavy.3.raw

SEQ ID NO: 457973 - DNA, 499 bp, Homo sapiens
  misc_feature: HEFZJCU01EHHG0.19.1.A01.1.454.heavy.3.raw
tactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaagtttcctgcaaggcttctggggacaccttcacctcctattctatcaactgggtgcgacaagcccctggacaagggcttgagtggatgggaggaagcatccctttctttgatactccagactacgcacagaagttccagggcagagtcacgattaccgcggacgaatccacgagcacagtctatatggaattgaccagcctgacatcagaggacacggccgtctatttttgtgtcgacagaaagagattccatactcaggcggggcactatggcagcagctgatacggtc

SEQ ID NO: 457974 - DNA, 505 bp, Homo sapiens; identical to SEQ ID NO: 447076
  misc_feature: HEFZJCU01CWLZQ.10.38.D05.1.454.heavy.3.raw

SEQ ID NO: 457975 - DNA, 520 bp, Homo sapiens; identical to SEQ ID NO: 455104
  misc_feature: HEFZJCU01CXZ08.13.76.G10.1.454.heavy.3.raw

SEQ ID NO: 457976 - DNA, 483 bp, Homo sapiens; identical to SEQ ID NO: 444924
  misc_feature: HEFZJCU01A3104.10.35.D02.1.454.heavy.3.raw

SEQ ID NO: 457977 - DNA, 379 bp, Homo sapiens; identical to SEQ ID NO: 444450
  misc_feature: HEFZJCU01D04J8.47.77.G11.1.454.heavy.3.raw

SEQ ID NO: 457978 - DNA, 524 bp, Homo sapiens; identical to SEQ ID NO: 445902
  misc_feature: HEFZJCU01BJYUN.9.78.H01.1.454.heavy.3.raw

SEQ ID NO: 457979 - DNA, 532 bp, Homo sapiens
  misc_feature: HEFZJCU01CFJWI.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcccctggattcactttcagtaaggcctggatgaactgggtccgccaggctccagggaagggctggagtgggttggccgtattaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacggtatggacctctc

SEQ ID NO: 457980 - DNA, 508 bp, Homo sapiens
  misc_feature: HEFZJCU01B6YGZ.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatactattactgtgcgaaagcaccggcagttagtcacccatactactttgactactgggg

SEQ ID NO: 457981 - DNA, 355 bp, Homo sapiens; identical to SEQ ID NO: 444443
  misc_feature: HEFZJCU01BYKTW.47.38.D05.1.454.heavy.3.raw

SEQ ID NO: 457982 - DNA, 500 bp, Homo sapiens
  misc_feature: HEFZJCU01BWOF2.48.74.G08.1.454.heavy.3.raw
agtatacatacacgaccggtgctcgatttagtagctctatcaggggaggtctgggagaggagccccagccctgagattcccaggtgtttccattcagtgatcagcactgaacacagaggactcaccatggagttgggactgagctggattttccttttggctcttttaacaggtgtccagtgtgaagtgcagctggtggagtctgggggaggcttggtacagcccggcaggtccctgagactctcctgtgcagcctctggattcatctttggtgattatgccatgcactgggtccggcgaattccagggaaggcctggagtgggtctcaggtattagttgggatggtgacagtataggctatgcggactctgtgaggggccgattcaccatcaccagggaaaacgccaataactccctgtgtctacaaatgaacaatctgagacctgaagacacggccttgttatttttgtgtaaaagatattctccgacaattatggtc

SEQ ID NO: 457983 - DNA, 519 bp, Homo sapiens; identical to SEQ ID NO: 445617
  misc_feature: HEFZJCU01EJX1K.9.34.D01.1.454.heavy.3.raw

SEQ ID NO: 457984 - DNA, 509 bp, Homo sapiens
  misc_feature: HEFZJCU01CIHDO.9.78.H01.1.454.heavy.3.raw
tgatacgtctcacgaccggtgctcgatttagtgtgagtagtttgggtttggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgacgagcacagcggccctgggctgcctggtcaaggactacttccagacgtatca

SEQ ID NO: 457985 - DNA, 506 bp, Homo sapiens
  misc_feature: HEFZJCU01BYMZ6.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaaggccgattcaccatctccagagacaacgccaagaactctctgtttctgcaaatggacagcctgagagtcgaagacacggctgtgtattactgtgtgtctctgacgcctcggccggaccttggcttcg

SEQ ID NO: 457986 - DNA, 524 bp, Homo sapiens; identical to SEQ ID NO: 446401
  misc_feature: HEFZJCU01BD2QI.3.82.H05.1.454.heavy.3.raw

SEQ ID NO: 457987 - DNA, 548 bp, Homo sapiens
  misc_feature: HEFZJCU01B1YMA.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccactgtgaggagcagttggtggagactggaggaagcctgatccagccggggggtccctgagactgtcctgtgtagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggcccgggggtaacccctgggttccacccggtcctccccacccctcccacccaaacgggg

SEQ ID NO: 457988 - DNA, 512 bp, Homo sapiens
  misc_feature: HEFZJCU01B7ZX9.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaaccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctgggggcacgagcggcctgggctgcctggtcaaggactacttcccatacc

SEQ ID NO: 457989 - DNA, 485 bp, Homo sapiens
  misc_feature: HEFZJCU01CFUUO.17.36.D03.1.454.heavy.3.raw
cgtagactagcacgaccggtgctcgatttagctgcgtcacgatctctcttggggctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctggggaggcttggtaccgcctggggggtccctgagactctcctgtagagcctctggattcgccttcagtacctacagcatgaactgggtccgccaggttccagggaagggtctggagtgggttgcatacattagtagtagtgatagttccatatactacgcagactctgtgaagggccgattcaccatctccagagacagtgccaagaactcactgtatctgcaaatgaacagccttagagacgacgacacggctgtgtattactgtgcgagagatcca

SEQ ID NO: 457990 - DNA, 498 bp, Homo sapiens
  misc_feature: HEFZJCU01DX5NG.10.38.D05.1.454.heavy.3.raw
catagtagtgcacgaccggtgctcgatttagtatctgatagttgggtttgggggggagaggagcccagcactgggattctgaggtgtttccattcggtgatcagcactgaacacagaggactcaccatggagttttggctgagctgggttttccttgttgctatttcaaaaggtgtccactgtgaggttcaactggtggagactggaggaggctggatccagcctgggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctgggcca

SEQ ID NO: 457991 - DNA, 535 bp, Homo sapiens
  misc_feature: HEFZJCU01BWBPW.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtaatggctgtgtttattggggccagggagccctggtctaccg

SEQ ID NO: 457992 - DNA, 513 bp, Homo sapiens
  misc_feature: HEFZJCU01AH097.52.27.C05.1.454.heavy.3.raw
cgcagtacgacacgaccggtgctcgatttagacgcgatcgaagggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaagggcttgagtggatggggtggaacaatcccaacagtggaggcaccggtcgcacagaatatgcgcggaagtttcagggcagggtcaccatgaccagcgacaggtccactaacacagcctacatggagctaagtagactgacatctgacgacacggccgtctattattgtgtgagagaggacccgatgacctcgaacatggacgtctggggccac

SEQ ID NO: 457993 - DNA, 381 bp, Homo sapiens; identical to SEQ ID NO: 445431
  misc_feature: HEFZJCU01AH4LG.3.70.G04.1.454.heavy.3.raw

SEQ ID NO: 457994 - DNA, 467 bp, Homo sapiens; identical to SEQ ID NO: 445004
  misc_feature: HEFZJCU01B16VT.16.78.H01.1.454.heavy.3.raw

SEQ ID NO: 457995 - DNA, 511 bp, Homo sapiens
  misc_feature: HEFZJCU01A39SJ.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctacttgactactggggccagggactctggtcaccgtctccgcagcctccaccaagggccc

SEQ ID NO: 457996 - DNA, 513 bp, Homo sapiens; identical to SEQ ID NO: 446452
  misc_feature: HEFZJCU01DW7UF.17.33.C11.1.454.heavy.3.raw

SEQ ID NO: 457997 - DNA, 391 bp, Homo sapiens; identical to SEQ ID NO: 444514
  misc_feature: HEFZJCU01CSSD2.12.24.C02.1.454.heavy.3.raw

SEQ ID NO: 457998 - DNA, 529 bp, Homo sapiens; identical to SEQ ID NO: 449445
  misc_feature: HEFZJCU01D35G8.12.40.D07.1.454.heavy.3.raw

SEQ ID NO: 457999 - DNA, 500 bp, Homo sapiens
  misc_feature: HEFZJCU01D84SG.13.11.A11.1.454.heavy.3.raw
tcacgtactacacgaccggtgctcgatttagctacgactgcaggggagctctgggagaggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtctgggggaggtgtggtacggcctggggggtccctcagactctcctgtgcaacctctggattcagatttgatgagtatggcatacactgggtccgccaacctccagggaaggggctgcagtgggtctctggtataactggaatggtgccagcacaacttatgcagactctgtgaagggccgattcaccatctccagagacagtgccgagaactccgtacatctgcaaatgaacagtctcggagtcgaggacacggccttgtatttctgtgcgaggttagcagtggctggtacttacgct

SEQ ID NO: 458000 - DNA, 499 bp, Homo sapiens
  misc_feature: HEFZJCU01C88KU.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggatccctgagactctcctgtgtagtctctggaatcagtttcagtaccttctggatgcactgggtccgccaaactccaggtaagggctggtgtgggtctcacgtatcaatcctgatggcagtgttataaattatgcggactccgtgaggggccgattcagcatctccagagacaacggcaagagtatactgtatctggaaatgaacaatctgagagtcgagatacggctggtctatcattgtgttttcgatgccttcggtccgcgggacttcgtggggcc

SEQ ID NO: 458001 - DNA, 508 bp, Homo sapiens
  misc_feature: HEFZJCU01CFIJE.11.67.G01.1.454.heavy.3.raw
cgagagataccacgaccggtgctcgatttagagtatacatattggggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaaggcccatcggtcttccccctggcaccctcctccaagagcacctctgggggcacagcggccctggctgcctgtcaaggactac

SEQ ID NO: 458002 - DNA, 519 bp, Homo sapiens; identical to SEQ ID NO: 450095
  misc_feature: HEFZJCU01EBZAL.47.53.E09.1.454.heavy.3.raw

SEQ ID NO: 458003 - DNA, 500 bp, Homo sapiens
  misc_feature: HEFZJCU01A7NHN.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtcttttgatgcctttgatatgtggggccaagggacaatggtcaccgtctt

SEQ ID NO: 458004 - DNA, 518 bp, Homo sapiens
  misc_feature: HEFZJCU01EKNF4.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgagacgacggtgtatactactgtacgaaggaggggggaaccaggcgggagttccaagtacttccg

SEQ ID NO: 458005 - DNA, 509 bp, Homo sapiens
  misc_feature: HEFZJCU01CQO6H.51.81.H04.1.454.heavy.3.raw
cgatcgtatacacgaccggtgctcgatttagtagtgtagattcgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccggggacacgtccatcgccacaacttacatggaactgaccagtctgacatttgacgacacggccgtctattactgtgcgacagaagcggcggacagaggttcgcttactggttcgaggctctccccacg

SEQ ID NO: 458006 - DNA, 536 bp, Homo sapiens
  misc_feature: HEFZJCU01A322E.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccagggagccctggtctaccg

SEQ ID NO: 458007 - DNA, 529 bp, Homo sapiens; identical to SEQ ID NO: 447055
  misc_feature: HEFZJCU01DBXSV.17.34.D01.1.454.heavy.3.raw

SEQ ID NO: 458008 - DNA, 486 bp, Homo sapiens
  misc_feature: HEFZJCU01C6KY6.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggccaggtcacgtctcctcggcctccaccaagggcccatcggtcttcccctggcgccctgctcacggagcgacctccgacgagcacagcggcctgggctgcctggtcaggactacttccactactcgta

SEQ ID NO: 458009 - DNA, 504 bp, Homo sapiens
  misc_feature: HEFZJCU01BRR68.26.80.H03.1.454.heavy.3.raw
agactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatatccactgggtgcggcaggcccctggacaagggcttgagtggatgggacacatcagccctaacactggtgacacaaactatgcacagagatttcagggcagggtcaccatgaccacggacacgtccataagcacagtttacatggaggtaaataggctgagatctgacgacacggccgtatattactgtgcgttattaacggacgattacgattgttttgatttggtttttac

SEQ ID NO: 458010 - DNA, 396 bp, Homo sapiens; identical to SEQ ID NO: 444469
  misc_feature: HEFZJCU01BJ2W2.47.46.E02.1.454.heavy.3.raw

SEQ ID NO: 458011 - DNA, 510 bp, Homo sapiens
  misc_feature: HEFZJCU01BXH0I.49.22.B11.1.454.heavy.3.raw
agtcgagagacacgaccggtgctcgatttagacgacagctcagggggctctgggagaggagccccagccctgagattctcaggtgtttcctttcagtgatcagcactgaccacagaggactcaccatggaattgggactgagcgtggagttttccttttaggttattttaaaaggtgtccactgtgaagtaatattggtggagtcggggggagacttggtacagcctggcaggtccctgagactctcctgtgaagcctctggactcactttcgaggattatgccatgcactgggtccggcaagctccaggaaagggcctggagtgggtcgcaggtcttagctcgaatagtgatgacatagcctatgcggactctgtgaagggccgattctccatttccagagacaacgccaggaggtccctgtttctgcagatgaatagactgagagatgaggacacggccttatattattgtagttaaagatgtctcgtctacactattttactactat

SEQ ID NO: 458012 - DNA, 516 bp, Homo sapiens
  misc_feature: HEFZJCU01DDN5I.48.33.C11.1.454.heavy.3.raw
agtatacatacacgaccggtgctcgatttagagtgagctcgttgggtttggggatttagatgtctgtgttgggtttggggggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactacttcctatgtata

SEQ ID NO: 458013 - DNA, 526 bp, Homo sapiens; identical to SEQ ID NO: 447476
  misc_feature: HEFZJCU01ESFSY.14.55.E11.1.454.heavy.3.raw

SEQ ID NO: 458014 - DNA, 480 bp, Homo sapiens
  misc_feature: HEFZJCU01A40IB.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttccccctggcgccctgctccaggagcacctccgagagcacagcggcctgggctgcctggtcaaggactacttccacgcgtatgt

SEQ ID NO: 458015 - DNA, 482 bp, Homo sapiens
  misc_feature: HEFZJCU01A0T5N.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagactttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttccccctggcgccctgctccaggagcacctccgagagcacagcggccctgggctgcctggtcaaggactacttcccacgagagta

SEQ ID NO: 458016 - DNA, 515 bp, Homo sapiens
  misc_feature: HEFZJCU01B7SJI.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtcctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctggggccaggggacc

SEQ ID NO: 458017 - DNA, 509 bp, Homo sapiens
  misc_feature: HEFZJCU01C6LB4.48.53.E09.1.454.heavy.3.raw
agtatacatacacgaccggtgctcgatttagagagagtgtgttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttactatggttcggggagtctccggacccagcaactggttccg

SEQ ID NO: 458018 - DNA, 481 bp, Homo sapiens
  misc_feature: HEFZJCU01DZR8Y.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttcccctggcgccctgctccaggagcacctccgagagcacagcggcccgtgggctgcctggtcaaggactacttcccacgagagta

SEQ ID NO: 458019 - DNA, 415 bp, Homo sapiens; identical to SEQ ID NO: 444794
  misc_feature: HEFZJCU01A08NL.14.74.G08.1.454.heavy.3.raw

SEQ ID NO: 458020 - DNA, 506 bp, Homo sapiens; identical to SEQ ID NO: 445425
  misc_feature: HEFZJCU01CEWSM.10.38.D05.1.454.heavy.3.raw

SEQ ID NO: 458021 - DNA, 499 bp, Homo sapiens
  misc_feature: HEFZJCU01DL7QK.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggccgccctgctccaggagcacctccgagagcacagcggccctgggctgcctggtcaaggactaccg

SEQ ID NO: 458022 - DNA, 374 bp, Homo sapiens; identical to SEQ ID NO: 446357
  misc_feature: HEFZJCU01CR7TT.51.75.G09.1.454.heavy.3.raw

SEQ ID NO: 458023 - DNA, 486 bp, Homo sapiens
  misc_feature: HEFZJCU01BIP0C.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgcctgctccaggagcacctccgagagcacagcggccctgggctgcctggtcaggctacttcccatactcgta

SEQ ID NO: 458024 - DNA, 530 bp, Homo sapiens; identical to SEQ ID NO: 456319
  misc_feature: HEFZJCU01CCELZ.18.33.C11.1.454.heavy.3.raw

SEQ ID NO: 458025 - DNA, 504 bp, Homo sapiens; identical to SEQ ID NO: 446672
  misc_feature: HEFZJCU01CYOLK.10.38.D05.1.454.heavy.3.raw

SEQ ID NO: 458026 - DNA, 527 bp, Homo sapiens
  misc_feature: HEFZJCU01C4AYT.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagtaatctggagctgaacagcctgtcatctgaggacacgggcttctacttctgtgcgaggagtaattactataacactgctccttttacacctcccttgacttctggggccatggaacccggtcaccgt

SEQ ID NO: 458027 - DNA, 497 bp, Homo sapiens; identical to SEQ ID NO: 445179
  misc_feature: HEFZJCU01AKQYT.12.55.E11.1.454.heavy.3.raw

SEQ ID NO: 458028 - DNA, 490 bp, Homo sapiens; identical to SEQ ID NO: 449137
  misc_feature: HEFZJCU01A6IIK.11.26.C04.1.454.heavy.3.raw

SEQ ID NO: 458029 - DNA, 518 bp, Homo sapiens
  misc_feature: HEFZJCU01B29RN.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttccccctggcaccctcctccaagagcacctctgggggcac

SEQ ID NO: 458030 - DNA, 518 bp, Homo sapiens
  misc_feature: HEFZJCU01A3KU2.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggactacttcttagagacacg

SEQ ID NO: 458031 - DNA, 509 bp, Homo sapiens
  misc_feature: HEFZJCU01ASGSD.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccaggcgggagttccaagtactcctttgacgtc

SEQ ID NO: 458032 - DNA, 519 bp, Homo sapiens
  misc_feature: HEFZJCU01DB4P9.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctctttttatttatagtagtggtagtacatactccgcagactccgtgaggggccgattcaccatctccagagacaattccaagaacacgctgtttcttcaatgaacagcctgagagccgatgacacggccgtgtattactgtgcgagagatggggcccacgaacgttactacgctatggacgtctggggccaagggaccg

SEQ ID NO: 458033 - DNA, 492 bp, Homo sapiens
  misc_feature: HEFZJCU01CXQVO.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaaagaacatggtgtatctgcaaatgaccagcctgagagccgaggacacgggtgtttattactgtagggagaaatccta

SEQ ID NO: 458034 - DNA, 530 bp, Homo sapiens
  misc_feature: HEFZJCU01DPFRG.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttccccctcggcgccctcgctccaggagcacctccgacgagcacagcggccctgggcg

SEQ ID NO: 458035 - DNA, 403 bp, Homo sapiens; identical to SEQ ID NO: 444540
  misc_feature: HEFZJCU01A1NK4.16.72.G06.1.454.heavy.3.raw

SEQ ID NO: 458036 - DNA, 514 bp, Homo sapiens
  misc_feature: HEFZJCU01B5XXA.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttacccctctggttccttcgacagttatggtatggacgtctggggcctagggactacggtcaccgtctcctcagcctccaccaagggccatcggtcttccccctggcca

SEQ ID NO: 458037 - DNA, 529 bp, Homo sapiens; identical to SEQ ID NO: 456162
  misc_feature: HEFZJCU01BOPIG.12.39.D06.1.454.heavy.3.raw

SEQ ID NO: 458038 - DNA, 500 bp, Homo sapiens; identical to SEQ ID NO: 446062
  misc_feature: HEFZJCU01DFKUX.12.38.D05.1.454.heavy.3.raw

SEQ ID NO: 458039 - DNA, 480 bp, Homo sapiens; identical to SEQ ID NO: 446171
  misc_feature: HEFZJCU01DU54S.22.36.D03.1.454.heavy.3.raw

SEQ ID NO: 458040 - DNA, 489 bp, Homo sapiens
  misc_feature: HEFZJCU01CBMP1.40.17.B06.1.454.heavy.3.raw
tctagcgactcacgaccggtgctcgatttagtcgatagtgaagggggcagagcctgctgaattctggctgactagggcagtcaccagagctccagacaatgtctgtctccttcctcatcttcctgcccgtgctgggcctcccatggggtgtcctgtcacaggtacagctgcagcagtcaggtccaggactggtgaagccctcgcagaccctctcactcacctgtgccatctccggggacagtgtctctggtaatagtgttgcttggaactggatcaggcagtccccatggagaggccttgagtggctgggaaggacatcctacaggtccgacaggtccgagtggttaaatgaatttgcagtttttgtggaaagtcgaataaccatcaatgcagacacatccaagaaccagttctccctgcacctaaactctatgactcccgaggacgcggctgtttattactgtgcaagaggacgaattgcatactatg

SEQ ID NO: 458041 - DNA, 491 bp, Homo sapiens; identical to SEQ ID NO: 444592
  misc_feature: HEFZJCU01AVE61.11.26.C04.1.454.heavy.3.raw

SEQ ID NO: 458042 - DNA, 519 bp, Homo sapiens
  misc_feature: HEFZJCU01DE76L.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggtagttttacgtagtttttggtagtggatatttaa

SEQ ID NO: 458043 - DNA, 506 bp, Homo sapiens
  misc_feature: HEFZJCU01B22R5.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgacgagcacagcggccctgggctgcctggtcaaggactactcccactacta

SEQ ID NO: 458044 - DNA, 505 bp, Homo sapiens; identical to SEQ ID NO: 445474
  misc_feature: HEFZJCU01DUTC9.16.34.D01.1.454.heavy.3.raw

SEQ ID NO: 458045 - DNA, 482 bp, Homo sapiens; identical to SEQ ID NO: 445434
  misc_feature: HEFZJCU01EEID2.19.53.E09.1.454.heavy.3.raw

SEQ ID NO: 458046 - DNA, 501 bp, Homo sapiens
  misc_feature: HEFZJCU01EXS49.22.11.A11.1.454.heavy.3.raw
acatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccgcggggtcacccaaatt

SEQ ID NO: 458047 - DNA, 414 bp, Homo sapiens; identical to SEQ ID NO: 453362
  misc_feature: HEFZJCU01DP3NV.40.81.H04.1.454.heavy.3.raw

SEQ ID NO: 458048 - DNA, 489 bp, Homo sapiens; identical to SEQ ID NO: 447877
  misc_feature: HEFZJCU01DNLBX.19.53.E09.1.454.heavy.3.raw

SEQ ID NO: 458049 - DNA, 491 bp, Homo sapiens; identical to SEQ ID NO: 444803
  misc_feature: HEFZJCU01CEOLM.4.57.F02.1.454.heavy.3.raw

SEQ ID NO: 458050 - DNA, 509 bp, Homo sapiens
  misc_feature: HEFZJCU01BB3HW.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggactccgtcacgcccccaggaaacggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactacgtggggccagggaactctggtcaccgtctccgcagcctccacc

SEQ ID NO: 458051 - DNA, 515 bp, Homo sapiens
  misc_feature: HEFZJCU01C37T1.13.76.G10.1.454.heavy.3.raw
tcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatcctccagagacaattccaagaacacgctgtttcttcaatgaacagcctgagagccgatgacacggccgtgtattactgtgcgagagatggggcccacgaacgttactacgctatggacgtctggggccaagggacc

SEQ ID NO: 458052 - DNA, 528 bp, Homo sapiens
  misc_feature: HEFZJCU01D2Y7C.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatcggtcttcccctggcgccctcg

SEQ ID NO: 458053 - DNA, 511 bp, Homo sapiens
  misc_feature: HEFZJCU01DK7GN.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacgggccacatattactgtgcgaaagatctcggggctgggttccgcggtccgggt

SEQ ID NO: 458054 - DNA, 498 bp, Homo sapiens
  misc_feature: HEFZJCU01AMLUV.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaacgatgcttttgatatgtgggaccg

SEQ ID NO: 458055 - DNA, 375 bp, Homo sapiens; identical to SEQ ID NO: 445125
  misc_feature: HEFZJCU01CYL17.9.53.E09.1.454.heavy.3.raw

SEQ ID NO: 458056 - DNA, 512 bp, Homo sapiens
  misc_feature: HEFZJCU01E0BF5.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaaggcccatcggtcttcccctggcaccctcctccaagagcacctctgggggcacagcggccctgggctgcctggtcaaggactacttccgacgtgcgtct

SEQ ID NO: 458057 - DNA, 514 bp, Homo sapiens; identical to SEQ ID NO: 451530
  misc_feature: HEFZJCU01E0YNL.13.76.G10.1.454.heavy.3.raw

SEQ ID NO: 458058 - DNA, 479 bp, Homo sapiens
  misc_feature: HEFZJCU01ENWEB.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaaggcccatcggtcttcccctggcgccctgctccaggagcacctccgagagcacagcggccctgggctgcctggtcaaggactacttccacgcgtatgt

SEQ ID NO: 458059 - DNA, 524 bp, Homo sapiens; identical to SEQ ID NO: 445902
  misc_feature: HEFZJCU01AVTI2.9.78.H01.1.454.heavy.3.raw

SEQ ID NO: 458060 - DNA, 520 bp, Homo sapiens
  misc_feature: HEFZJCU01C0QBJ.48.53.E09.1.454.heavy.3.raw
agtatacatacacgaccggtgctcgatttagagagagtgtgttgggtttgggttttccttgttgctattttagaaggtgtccagtgtgaagtgcagctggtggagtctgggggaggcttggtccagcctggggggtccctaagactctcctgtgcagcctctggattcacctttagtacctattggatgacctgggtccgccaatctccaggggggggggctggagtgggtggccaatataaagggagatggaagtgtgacacactatgtggactctgtgaagggccgattcaccatctccagagacaatgccaaggagtcactgtatctgcagatgaacagcctgagagccgaggacgcggctgtgtattactgtgcgagagatgcgaatccctctgatagtaatggtcgttattatgatgctttgatatgtggggccaagggacaacggtcaccgtctcttcagcctccaccaacgggcccatcggtcttccccctggccgccctcgcctccaggacg

SEQ ID NO: 458061 - DNA, 491 bp, Homo sapiens; identical to SEQ ID NO: 446954
  misc_feature: HEFZJCU01DGQZO.17.16.B05.1.454.heavy.3.raw

SEQ ID NO: 458062 - DNA, 486 bp, Homo sapiens; identical to SEQ ID NO: 446117
  misc_feature: HEFZJCU01AFQQS.51.14.B03.1.454.heavy.3.raw

SEQ ID NO: 458063 - DNA, 496 bp, Homo sapiens
  misc_feature: HEFZJCU01EQE8A.22.86.H09.1.454.heavy.3.raw
acatacgcgtcacgaccggtgctcgatttagtgctatagacttgggtttggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctgggagtggggtggcaatttatatggtatgatggaagtaataaagactatgtggactccgtgaagggccgattcaccatctccagagacaactcaagaacactctgtttctccaaatgaacagcctgagaggcgaggacacggcagtgtattactgtgcgagagatcgacatgactacggg

SEQ ID NO: 458064 - DNA, 501 bp, Homo sapiens
  misc_feature: HEFZJCU01AYVXU.19.26.C04.1.454.heavy.3.raw
tactctcgtgcacgaccggtgctcgatttagtctagcgactttgggtttgggctgagcgtggtttcgtcgttaggctctttaagtaggtgtccagtgtcaggtgcacctggtggagtctgggggaggcgtggtccagcctgggaggtccctgagactctcctgtgcagcctctggattcaccttcagtagctttggcatccactgggtcagccaggctccaggcaaggggctaggagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctcccagcctccaccaagggcccatcggtcttcccctgcgcctgct

SEQ ID NO: 458065 - DNA, 324 bp, Homo sapiens; identical to SEQ ID NO: 444475
  misc_feature: HEFZJCU01BTS18.18.17.B06.1.454.heavy.3.raw

SEQ ID NO: 458066 - DNA, 487 bp, Homo sapiens
  misc_feature: HEFZJCU01CKHX2.47.55.E11.1.454.heavy.3.raw
agctcacgtacacgaccggtgctcgatttagcactcgcacgttgggtttgggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaaccctggtcagcgtctcctcagcctccaccaagggcccatcggtcttcccctggcgccctgctccaggagcacctccgagagcacagcggcccgtgggctgcctggtcaaggactacttcctacgtgagct

SEQ ID NO: 458067 - DNA, 496 bp, Homo sapiens
  misc_feature: HEFZJCU01CXJI2.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacgtggtttggggctactggggccaggggaaccctggtcaccgtctcctcagcctccaccg

SEQ ID NO: 458068 - DNA, 508 bp, Homo sapiens
  misc_feature: HEFZJCU01BD6B9.11.67.G01.1.454.heavy.3.raw
cgagagataccacgaccggtgctcgatttagagtatacatattggggggggcttggtgcagccgagggggtccctgagactctcctgtgtaggctctggattcagttttagcagctacgccatgacctgggtccgccaggctccagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggaccacggtcatcgtctcctcagcctccaccaagggcccatcggtcttcccctggcaccctcctccaagagcacctctgggggcacagcggcctgggctgcctggtcaaggatac

SEQ ID NO: 458069 - DNA, 500 bp, Homo sapiens
  misc_feature: HEFZJCU01C7V2C.48.21.B10.1.454.heavy.3.raw
agtatacatacacgaccggtgctcgatttagtgtcgtcgcaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaagtcgaggcaccatatccgtagacacgtccaagaccaattctccctgaagctgagctctgtgaccgccgcagacacggctgtctattactgtgcgaggccccgagcgcagtggctttttgatgcctttgatatgtggggccaagggacaatggtcaccgtctctt

SEQ ID NO: 458070 - DNA, 502 bp, Homo sapiens
  misc_feature: HEFZJCU01CA2QG.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgaggctgtgagcgccgcagacacggccgtgtattactgtgcgagactggccgcaacagactacgggtggcaactccctatgtcttttgatatctggggccaagggac

SEQ ID NO: 458071 - DNA, 515 bp, Homo sapiens
  misc_feature: HEFZJCU01DTYSL.13.21.B10.1.454.heavy.3.raw
  modified_base (512)..(512): a, c, t, g, unknown or other
tcacgtactacacgaccggtgctcgatttagtgtcgtcgcaaagagagaggagccttagccctggactccaaggcctttccacttggtgatcagcaatgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaaatggaccgcctgagagacgaggacacggctatgtattactgtgcgagagatgagagtggctacgagttggggccgggaacctggtcaccgtnaac

SEQ ID NO: 458072 - DNA, 514 bp, Homo sapiens
  misc_feature: HEFZJCU01EK26F.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcgttttcttagtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatacctacttttgactactggggccg

SEQ ID NO: 458073 - DNA, 517 bp, Homo sapiens
  misc_feature: HEFZJCU01EP4WZ.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttccccctggcaccctcctccaagagcacctctgggggcacagcggccctggctgcctggtcaaggactacttccagacgtatca

SEQ ID NO: 458074 - DNA, 496 bp, Homo sapiens
  misc_feature: HEFZJCU01EIG5F.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctaagtggc

SEQ ID NO: 458075 - DNA, 482 bp, Homo sapiens; identical to SEQ ID NO: 444503
  misc_feature: HEFZJCU01B8S38.7.10.A10.1.454.heavy.3.raw

SEQ ID NO: 458076 - DNA, 325 bp, Homo sapiens
  misc_feature: HEFZJCU01EJFSU.48.14.B03.1.454.heavy.3.raw
agtatacatacacgaccggtgctcgatttagtgtgagtagttccgcggggtctgtgaagggccggttcaccatctacagagacaacggcaagaagtcgctgtttctgcaaatgaacagcctgacctccgacgacacggctctctattattgtgtgagagaatcctggggaccggccgtcttcgggggccagggaacactggttatcgtctcttcagcctccaccaagggcccatcggtcttccccctggcgccctgctccaggagcacctccgagagcacagcggccctgggctgcctggtcaaggactacttcctatgtatact

SEQ ID NO: 458077 - DNA, 508 bp, Homo sapiens
  misc_feature: HEFZJCU01CWXZ2.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctgggtcatcgtctcctcagcctccaccaagggcccatcggtcttcccctggccaccctcctccaagagcacctctgggggcacagcggccctgggctgcctggtcaaggactacttccgagtagtaca

SEQ ID NO: 458078 - DNA, 483 bp, Homo sapiens; identical to SEQ ID NO: 447485
  misc_feature: HEFZJCU01BPM78.40.71.G05.1.454.heavy.3.raw

SEQ ID NO: 458079 - DNA, 497 bp, Homo sapiens
  misc_feature: HEFZJCU01CU4LF.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaaggactacg

SEQ ID NO: 458080 - DNA, 502 bp, Homo sapiens
  misc_feature: HEFZJCU01ERUSW.22.30.C08.1.454.heavy.3.raw
acatacgcgtcacgaccggtgctcgatttagtctgacgtcaaagggaaaggggctcagagaggagccttagccccggactccaaggcctttccacttggtgatcagcactgagcacagaggactcaccatgggattggggctgagctggcttttccttgttgctattttagaaggtgtccagtgtgaggtgcgcctggtggaatctgggggggccttggtccagcctggggggtccctgagactcgcctgtgcagcctctggattcgagtttggagcctactgtctgacttgggtccgccaggctccagggaaggggctggagtgggtggccagcatcaacgaagacggacataaggaattttatgtggcctctgtgaagggccgattcaccatctccagagacaacgtcaagaactcactgtttctgcagatggacagcctgcgagccgaggacacggctgtctatttctgtgtcagagacgagatactacagtattctta

SEQ ID NO: 458081 - DNA, 519 bp, Homo sapiens
  misc_feature: HEFZJCU01D44SB.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccgaggcgggagttccaagtacttcc

SEQ ID NO: 458082 - DNA, 484 bp, Homo sapiens
  misc_feature: HEFZJCU01BL6F1.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaagtttgccagtcataccacagaatatgccgcgactgtgaagggcagagtcaccatcgtcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctggcaccctcctccaagagcacctctgggggcacagcggccctgggctgcctggtcaaggactacttccgtatctctcg

SEQ ID NO: 458083 - DNA, 536 bp, Homo sapiens
  misc_feature: HEFZJCU01DHT2G.52.73.G07.1.454.heavy.3.raw
cgcagtacgacacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactatacccgtcccttaagagtcgagtcaccatatcagtcgacacgtccaagaaccaattctccctgaaggtgaggtctgttaccgccgcggacacggctgtctatactgtgcgaaaggccctcacgatgaaactacgccctgcgctatggacgtctggggccaagggaccacggtcaccgtctcctcacgcctccaccaacgggcccatcggtcttccccctc

SEQ ID NO: 458084 - DNA, 482 bp, Homo sapiens; identical to SEQ ID NO: 444503
  misc_feature: HEFZJCU01AX9FR.7.10.A10.1.454.heavy.3.raw

SEQ ID NO: 458085 - DNA, 427 bp, Homo sapiens; identical to SEQ ID NO: 444708
  misc_feature: HEFZJCU01CLJVS.9.34.D01.1.454.heavy.3.raw

SEQ ID NO: 458086 - DNA, 516 bp, Homo sapiens
  misc_feature: HEFZJCU01DECB0.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctcgcagtcgacactttgattactggggccggggaaccctggtcgccgtctcctcagcctccaccaaggcccatcggtcttcccctggcaccctcctccaagagcacctctgggggcacagcggccctgggctgcctggtcaaggactacttccagacgtatca

SEQ ID NO: 458087 - DNA, 512 bp, Homo sapiens
  misc_feature: HEFZJCU01AMSBM.12.27.C05.1.454.heavy.3.raw
atacgacgtacacgaccggtgctcgatttagacgcgatcgaagggtttggggtctgagagaggagcccagccctgggattttcaggtgttttcatttggtgatcaggactgaacagagagaactcaccatggagtttgggctgagcgtgtcgttttctaggtggctattttaaaaggtgtccagtgtgaggtgcaattggtggagtctgggggaggcttggtacagccgggggggtccctgagactctcctgtgcaggctctggattcatctttaacaactatgccatgagctgggtccgccaggctccagggaaggggctggagtgggtctcagctattagtaatagtggtgatagcacatcctacgcagactccgtgaagggccgcttcaccatctccagagacaattccaagaacacgctgtatctccaaatgaacagtctcagagccgaggacacggccatatattacctgtgcgaaagacacagccgcatttggggggagtcatcgt

SEQ ID NO: 458088 - DNA, 387 bp, Homo sapiens; identical to SEQ ID NO: 445229
  misc_feature: HEFZJCU01CLUA5.11.20.B09.1.454.heavy.3.raw

SEQ ID NO: 458089 - DNA, 516 bp, Homo sapiens
  misc_feature: HEFZJCU01EG7R5.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaggagcacctccgagagcacagcc

SEQ ID NO: 458090 - DNA, 511 bp, Homo sapiens; identical to SEQ ID NO: 445840
  misc_feature: HEFZJCU01CCFDI.11.13.B02.1.454.heavy.3.raw

SEQ ID NO: 458091 - DNA, 539 bp, Homo sapiens
  misc_feature: HEFZJCU01E0IVZ.51.49.E05.1.454.heavy.3.raw
cgatcgtatacacgaccggtgctcgatttagagcgactagcaacacacaaaggggggttttctgagagtcatggacctcctggacaagaacatgaaacccctgtggttcttcctcctcctggtggcagctcccagatgggtcctgtcccaggtgcaactgcagcagaggggcgcaagactgttgaagcctttggagaccctgtccctcacctgcactctttctggtgcgactttcagtggttatttctggggctgggtccgccagccccccgggaacgggacttcagtggattggggaaatcagtcgtagtggagagaccttctacaacccgtccctcaagagtcgagtcgccatatcaacagacgcgtccaagagtgaggtgtccctgacactcaggtctgtgaccgccgcggacgcggctgtatactactgtgcgagagtccccgctgggttttggagtggttattatgccggtatggacgtctggggcgcagggaccacggtcgccgtctcttcagcctccaccaagggcccatcc

SEQ ID NO: 458092 - DNA, 400 bp, Homo sapiens
  misc_feature: HEFZJCU01DST3J.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgatgctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 458093 - DNA, 492 bp, Homo sapiens
  misc_feature: HEFZJCU01EE31S.19.59.F04.1.454.heavy.3.raw
tactctcgtgcacgaccggtgctcgatttagtacacacacttagggattgggggcagctctcagagaggtgccctagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggagggtccctgagactctcctgtgcagcctctggattcaccttcagtagttatgaaatgaattgggtccgccaggctccagggaaggggctggagtgggtttcatacattagtagtagtggtagtagcatatactacgcagactctgtgaagggccgattcaccatctccagagacagcgccaagaactcactgtatctgcaaatgaacagcctgagagccgaggacacggcagtttattactgtgcgagagagtggc

SEQ ID NO: 458094 - DNA, 507 bp, Homo sapiens
  misc_feature: HEFZJCU01E0NAG.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctgggggccaagggaccacgggtcatcgtctccccagcctccaccaagggcccatcggtcttcccctggcgccctgctcca

SEQ ID NO: 458095 - DNA, 503 bp, Homo sapiens; identical to SEQ ID NO: 445995
  misc_feature: HEFZJCU01D62AW.17.25.C03.1.454.heavy.3.raw

SEQ ID NO: 458096 - DNA, 491 bp, Homo sapiens; identical to SEQ ID NO: 444749
  misc_feature: HEFZJCU01EYX1H.11.13.B02.1.454.heavy.3.raw

SEQ ID NO: 458097 - DNA, 528 bp, Homo sapiens
  misc_feature: HEFZJCU01AY5CT.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaatgaacagcctgagaaccgaggacacagccgtgtattactgtaccacatccctgaaagcgtcaactactactactacgtatggacctctggg

SEQ ID NO: 458098 - DNA, 528 bp, Homo sapiens
  misc_feature: HEFZJCU01BHLL7.22.85.H08.1.454.heavy.3.raw
acatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaaggggccgattcaccatctcagaagacaattccaggaacacattgtatcttcaaatgaataacctgagagcccgaggacacggccatgtattactgtgtgggggcatttacttgcccctggggccgggggaaccctggtcaccgtctccccacccctcaccc

SEQ ID NO: 458099 - DNA, 513 bp, Homo sapiens
  misc_feature: HEFZJCU01ESRCX.3.71.G05.1.454.heavy.3.raw
agacgcactccacgaccggtgctcgatttagtgtcgtcgcaagagagagggggctgggagaggagccccagccctgagattcccaggtgtttccattcagtgatcagcactgaacacagaggactcaccatggagttgggactgagctggattttccttttggctattttaaaaggtgtccggtgtgaagtgcaactggtggagtctgggggaggcttggtacagcctggcaggtccctgagactctcctgtgcagcctctggattcacctttgatgattatgccatgcactgggtccggcaagctccagggaagggcctggagtgggtctcaggtattacttggaatagtgataacatcggctatgcggactctgtgaagggccgattcaccatctccagagacaacgccaagaactccctgtatctgcaaatgaacagtctgagacctgaggacacggccttgtattactgttgtaaagtcccggggaaatatgtacgtattttggaactt

SEQ ID NO: 458100 - DNA, 511 bp, Homo sapiens
  misc_feature: HEFZJCU01EVLA9.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggtacccg

SEQ ID NO: 458101 - DNA, 534 bp, Homo sapiens
  misc_feature: HEFZJCU01A62VS.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgaccctggggcccgggaaccctggtcaccgtctcctcagcctccaccaagggcccatcggtccttcccctc

SEQ ID NO: 458102 - DNA, 437 bp, Homo sapiens; identical to SEQ ID NO: 444603
  misc_feature: HEFZJCU01CDDHC.3.21.B10.1.454.heavy.3.raw

SEQ ID NO: 458103 - DNA, 519 bp, Homo sapiens
  misc_feature: HEFZJCU01C76U3.52.27.C05.1.454.heavy.3.raw
cgcagtacgacacgaccggtgctcgatttagacgcgatcgaagggtttgggggcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaagggcttgagtggatggggtggaacaatcccaacagtggaggcaccggtcgcacagaatatgcgcggaagtttcagggcagggtcaccatgaccagcgacaggtccactaacacagcctacatggagctaagtagactgacatctgacgacacggccgtctattattgtgtgagagaggacccgatgacctcgaacatggacgtctggggccagggggaccg

SEQ ID NO: 458104 - DNA, 508 bp, Homo sapiens
  misc_feature: HEFZJCU01DFGFW.51.5.A05.1.454.heavy.3.raw
cgatcgtatacacgaccggtgctcgatttagatagatagacaggggagtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtcctgcacctcgtgtggccccaattggtttaccggcacacaaatcagggcaagtcctacgacggtctc

SEQ ID NO: 458105 - DNA, 323 bp, Homo sapiens
  misc_feature: HEFZJCU01D268P.49.10.A10.1.454.heavy.3.raw
agtcgagagacacgaccggtgctcgatttagcgtcgatctcagggtcttcgtggctcacgtccaccaccacgcatgtgacctcaggggtccgggagatcatgagggtgtccttgggttttggggggaagaggaagactgacggccccccctttcaggagcgatcatactactttgaccactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 458106 - DNA, 508 bp, Homo sapiens; identical to SEQ ID NO: 445594
  misc_feature: HEFZJCU01EHVDH.17.25.C03.1.454.heavy.3.raw

SEQ ID NO: 458107 - DNA, 415 bp, Homo sapiens; identical to SEQ ID NO: 444794
  misc_feature: HEFZJCU01B381K.14.74.G08.1.454.heavy.3.raw

SEQ ID NO: 458108 - DNA, 505 bp, Homo sapiens
  misc_feature: HEFZJCU01C4IVU.17.10.A10.1.454.heavy.3.raw
  modified_base (462)..(462): a, c, t, g, unknown or other
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggaccacccccacgaaacacagtctacatgcaactgacgagcctgagagctgacgacacggccgtctattactgtgcgagaatgttttcngtcatcgtactaatttgataggctctatggactggacttcgtc

SEQ ID NO: 458109 - DNA, 501 bp, Homo sapiens
  misc_feature: HEFZJCU01B35FG.7.85.H08.1.454.heavy.3.raw
cgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccagggaaggggctgcagtgggtttcacacattaatactggaagtaggaccataacttacacagactctgtgaagggccgattcaccacctccagagacgacgccaagaactcactgtctctgcaaatgaacagcctgagagtcgaggacacggctgtgtattactgtgcgagagatccggagggggacgtatgacc

SEQ ID NO: 458110 - DNA, 517 bp, Homo sapiens
  misc_feature: HEFZJCU01D52C0.15.8.A08.1.454.heavy.3.raw
tctacgtagccacgaccggtgctcgatttagcatactctacagggtcttcgtggctcacgtccaccaccacgcatgtgacctcagggtccctgagactctcctgtgccgcctctggagcagagtctgaattcaccttcatgcactttgccatgagctgggtccgccaggctccggggaaggggctggagtgcgtcgcatgtataactaaaagtggagacatcacactctacgcagactccgtgaagggccgcttcaccatctccagagacaactccaagaacacgctgtccctggagatgaacagcctgagagccgaggacacggccatttattactgtgcgaaagatagttcgggagtaattatcgagaatactatttgactcctggggccagggagccctggtcaccgtctcctcagcctccaccaagggcccatccggtcttcccctggcaccctcctccaagagcacctcctggggggccacgagcggcccgtgggccgtgccctggtcaaac

SEQ ID NO: 458111 - DNA, 506 bp, Homo sapiens
  misc_feature: HEFZJCU01C6AG7.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgccctgctccaggagcacctccgagagcacagcggccctgggctgcctggtcaaggactacttcccactaccta

SEQ ID NO: 458112 - DNA, 482 bp, Homo sapiens; identical to SEQ ID NO: 457134
  misc_feature: HEFZJCU01EC1UR.10.35.D02.1.454.heavy.3.raw

SEQ ID NO: 458113 - DNA, 371 bp, Homo sapiens
  misc_feature: HEFZJCU01E0A9O.18.31.C09.1.454.heavy.3.raw
tacgagtatgcacgaccggtgctcgatttagacgtctcatcaaggaaggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaagggcccatcggtcttccccctggcaccctcctccaagagcacctctggggcacagcggccctgggctgcctggtcaaggactacttcccatactcgta

SEQ ID NO: 458114 - DNA, 498 bp, Homo sapiens
  misc_feature: HEFZJCU01ERULL.52.83.H06.1.454.heavy.3.raw
cgcagtacgacacgaccggtgctcgatttagatcacgtgcgtcgcggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctgatgcctccatcagtcgtgacgattactactggagctggatccgccagcccccagggaagggcctggaatggattggctacatcttttacagtgagagcacctcctacaacccgtccctcaagagtcgagttaccatatcagctgacaagtccaagaaccacttctccctgaagctgacctctgtgactgccacagacacggccgtctattactgtgccagagggatcgctagaggtgctccatcgttttagactcctgggccagggaaccctggtctccgt

SEQ ID NO: 458115 - DNA, 538 bp, Homo sapiens
  misc_feature: HEFZJCU01EICWX.48.12.B01.1.454.heavy.3.raw
agtatacatacacgaccggtgctcgatttagtagtgtagattccgcggggatgctttctgagagtcatggatctcatgtgcaagaaaatgaagcacctgtggttcttcctcctgctggtggcgtctcccagatgggtcctgtcccagctgcacctgcaggagtcgggcccaggactggtgaggccttcggagaccctgtccctcacctgcactgtctctggtgactccatcaacagtggtactttttactactggggctggatccgccagaccccagggaagggtctggagtggattgggagtgtctattctagtgggaaccacccactacaatcccgtccctcaagagtcgagtcaccatatccgtggacacgtccaagaacgagttctccctgaggttacaatctgtgatcgccgcagacacggttgtatattactgtgcgagacaccgggagggggcttactatggagtcggggcgggtagttacttacttttgactacgtgggggccgagggacgtcgtggtcaccggtctccc

SEQ ID NO: 458116 - DNA, 496 bp, Homo sapiens
  misc_feature: HEFZJCU01E18LR.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctgggccgtggcaccctgctgactgtctcctcagcctccaccaagggcccatcggtcttccccctggcgccctgctccaggagcacctccgagagcacagcggccctgggctgcctggtcaaggactac

SEQ ID NO: 458117 - DNA, 531 bp, Homo sapiens
  misc_feature: HEFZJCU01CJABV.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagg

SEQ ID NO: 458118 - DNA, 360 bp, Homo sapiens; identical to SEQ ID NO: 454498
  misc_feature: HEFZJCU01CDG52.40.41.D08.1.454.heavy.3.raw

SEQ ID NO: 458119 - DNA, 547 bp, Homo sapiens
  misc_feature: HEFZJCU01EFUE1.49.25.C03.1.454.heavy.3.raw
agtcgagagacacgaccggtgctcgatttagtagtgtagatttgggtttgggctgagctggctttttcttgtggctactttaaaaggtgtccagtgtgacgtccaactggtggagtctgggggaggcttggtgcagcctggggggtccctgagactctcctgtgtagcctctgagttcacctttagagtctatgccatgagttgggtccgccaggctccagggaaggggctggagtgggtctcaggtatcagtggtaatgatggtaacacaaactatgcagactccgtgaagggccggttcaccatctccagagacaattccaagaatatgctatttctgcaaatgaacagcctgagaatcgaggacacggccgtatattactgtgtgaaagaagatggaccgcgtggacgaggagcccgtacggcgggtcctactttgactactggggccggggaacccgtggtccaccgtctcctcagcctccaccaacggcccatcggtcttccccctcggccaccctcctccaagagcacctctgggggcacg

SEQ ID NO: 458120 - DNA, 370 bp, Homo sapiens; identical to SEQ ID NO: 445884
  misc_feature: HEFZJCU01DJBC2.3.42.D09.1.454.heavy.3.raw

SEQ ID NO: 458121 - DNA, 549 bp, Homo sapiens
  misc_feature: HEFZJCU01DVJLP.21.46.E02.1.454.heavy.3.raw
tcgtcgctcgcacgaccggtgctcgatttagactcatctacagggaaagggtgtacacctgtggttctcggggctgccctttggttttggagatggttttctcgatgggggctgggaggcttagttcaaccgggggggtccctgagactctcttgtgcagcctctcgatttaacttcaatatttactggatgcactgggtccgccaagctccagggaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggactggagtggttattattcctgggccagggaaccctggtaaccgtctcctcagcctccaccaagggcccatcggtcttcccctggcgccctgctccaggagcacctccgagacgcacagcggcccgtgggctgcctggtcaaggactacttcccgacg

SEQ ID NO: 458122 - DNA, 486 bp, Homo sapiens
  misc_feature: HEFZJCU01CHR8S.40.65.F10.1.454.heavy.3.raw
tctagcgactcacgaccggtgctcgatttagctacgctctaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgccttgatatgtggggcaagggacaat

SEQ ID NO: 458123 - DNA, 316 bp, Homo sapiens; identical to SEQ ID NO: 444479
  misc_feature: HEFZJCU01C3P4U.47.84.H07.1.454.heavy.3.raw

SEQ ID NO: 458124 - DNA, 514 bp, Homo sapiens
  misc_feature: HEFZJCU01CTO3Z.19.26.C04.1.454.heavy.3.raw
  modified_base (509)..(509): a, c, t, g, unknown or other
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatcctattacggtttggacgtcgtggggccaagggaccacggtcatcgtcctccccagcctccaccaagggcccatcggtcttcccctggcgcctgctccagngcacc

SEQ ID NO: 458125 - DNA, 420 bp, Homo sapiens
  misc_feature: HEFZJCU01C2IDL.16.78.H01.1.454.heavy.3.raw
tgtactactccacgaccggtgctcgatttagtgtgagtagtttgggtttggggcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcggggactacctcgacccctggggccagggaatactggtcaccgtctcctcagcctccaccaagggcccatcggtcttccccctggcaccctcctccaagagcacctctgggggcacagcggccctgggctgcctggtcaaggactacttccgagtagtaa

SEQ ID NO: 458126 - DNA, 501 bp, Homo sapiens
  misc_feature: HEFZJCU01C40D9.13.55.E11.1.454.heavy.3.raw
tcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagatccaacccttacgatttttggagtt

SEQ ID NO: 458127 - DNA, 384 bp, Homo sapiens; identical to SEQ ID NO: 444454
  misc_feature: HEFZJCU01AFY6Z.11.61.F06.1.454.heavy.3.raw

SEQ ID NO: 458128 - DNA, 507 bp, Homo sapiens
  misc_feature: HEFZJCU01CXTTC.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttcccaggacagagtcaccatgaccacagacacatccacgagcacagcctacatggaactgaggagcctgagatctgacgacacggccgtatatttctgcgcgagagacgtaaaagtgacgtggtagttccggggggacacatgacacc

SEQ ID NO: 458129 - DNA, 483 bp, Homo sapiens; identical to SEQ ID NO: 444924
  misc_feature: HEFZJCU01E1FCH.10.35.D02.1.454.heavy.3.raw

SEQ ID NO: 458130 - DNA, 521 bp, Homo sapiens; identical to SEQ ID NO: 445317
  misc_feature: HEFZJCU01BYS3W.12.40.D07.1.454.heavy.3.raw

SEQ ID NO: 458131 - DNA, 534 bp, Homo sapiens
  misc_feature: HEFZJCU01B4LK3.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattgggaatcaatcatggtggatacaccaactacaacccgtccctcaagagccgagtcaccatcttagtggacacggcgaagaacccagttctccctgaaactgaccgctgtgaccgccgcggacacggctgtgtattactgtgcgagacgaatgggcgggtgggctacgacttgacttttggggtccaggggaaaccgtggtcaccgtctccccagccttcccaccaagggcccactcggtcctttcccccg

SEQ ID NO: 458132 - DNA, 522 bp, Homo sapiens; identical to SEQ ID NO: 449550
  misc_feature: HEFZJCU01CUE30.12.40.D07.1.454.heavy.3.raw

SEQ ID NO: 458133 - DNA, 469 bp, Homo sapiens; identical to SEQ ID NO: 449151
  misc_feature: HEFZJCU01D8B5N.4.36.D03.1.454.heavy.3.raw

SEQ ID NO: 458134 - DNA, 503 bp, Homo sapiens; identical to SEQ ID NO: 450415
  misc_feature: HEFZJCU01AM0YJ.15.55.E11.1.454.heavy.3.raw

SEQ ID NO: 458135 - DNA, 507 bp, Homo sapiens
  misc_feature: HEFZJCU01C5F35.14.25.C03.1.454.heavy.3.raw
cgtctagtaccacgaccggtgctcgatttagtagtgtagatttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaacgggcccatcggtcttcccctc

SEQ ID NO: 458136 - DNA, 521 bp, Homo sapiens
  misc_feature: HEFZJCU01AHUQF.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgcccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggcg

SEQ ID NO: 458137 - DNA, 505 bp, Homo sapiens
  misc_feature: HEFZJCU01B82EN.10.23.C01.1.454.heavy.3.raw
catagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcagctttgatgaatatgccatggactggggtccggcaagttccagggaaggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagagggagtcgagggtttctaaac

SEQ ID NO: 458138 - DNA, 500 bp, Homo sapiens; identical to SEQ ID NO: 446033
  misc_feature: HEFZJCU01EH3MB.11.27.C05.1.454.heavy.3.raw

SEQ ID NO: 458139 - DNA, 529 bp, Homo sapiens
  misc_feature: HEFZJCU01EGU7C.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgacttctgggccatcggaaccccggtccg

SEQ ID NO: 458140 - DNA, 530 bp, Homo sapiens
  misc_feature: HEFZJCU01EWN37.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggacgtacggtgactacgtgggggttcgaccccgtggggccaggggaaccctggtcaccgtctcctcagcctccaccg

SEQ ID NO: 458141 - DNA, 524 bp, Homo sapiens
  misc_feature: HEFZJCU01CMEQL.9.70.G04.1.454.heavy.3.raw
  modified_base (325)..(325): a, c, t, g, unknown or other
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccnccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctagttaaaactcctactacggtctcggacgtcgtggggccgaggggaccgtaac

SEQ ID NO: 458142 - DNA, 511 bp, Homo sapiens; identical to SEQ ID NO: 446675
  misc_feature: HEFZJCU01BCU3P.4.23.C01.1.454.heavy.3.raw

SEQ ID NO: 458143 - DNA, 526 bp, Homo sapiens
  misc_feature: HEFZJCU01AEFGN.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaagggcccatcggtcttcccctggcaccctcctccaagagcacctctgggggcacagcggccctggctg

SEQ ID NO: 458144 - DNA, 524 bp, Homo sapiens
  misc_feature: HEFZJCU01BWIHE.49.15.B04.1.454.heavy.3.raw
agtcgagagacacgaccggtgctcgatttagacagtatatatccgcggggacactttctgagagtcctggacctcctgtgcaagaacatgaaacatctgtgggtcttccttctcctggtgacagctcccagatgggtcctgtcccaggtgcagctgcaggagtcgggcccaggactggtgaagccttcggagaccctgtccctcacctgcactgtctctggtggctccgttagtagttactattggagctgggtccggcagtcccccgggaagggactggaatggattggctatatctactacagtggaagcaccgattacaatccctccctcaagagtcgagtcagcatttcagccgacaggtccaagaaccagttctccctgaagttgaagtctgtgaccgctgcggacacggccgtgtatttctgtgcggttgatgattaccttcgggggactcatcgtactttcgacatctggggccgagggacaacagtcatcgtctcttcaacctccaccaagggccc

SEQ ID NO: 458145 - DNA, 525 bp, Homo sapiens
  misc_feature: HEFZJCU01CYHX9.12.71.G05.1.454.heavy.3.raw
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgaccctcggggccagggacccaggtcaccgtctcctcagcctccaccaagggcccatccgtcttcccctggcgccctgctccaggagcacctcccgagagcacagcggccctggggcctgcctggtcaaggactaacttcctaccg

SEQ ID NO: 458146 - DNA, 487 bp, Homo sapiens
  misc_feature: HEFZJCU01CID3S.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgacgggactcatgaacaatatgcagactccgtgaagggccgattcatcatctccagagacaactccaaacaacacactggatctccaaatgaacagcctgagagtcgaggacacggccgtattattattgtgtcccttgatta

SEQ ID NO: 458147 - DNA, 511 bp, Homo sapiens; identical to SEQ ID NO: 445268
  misc_feature: HEFZJCU01BAXD5.48.34.D01.1.454.heavy.3.raw

SEQ ID NO: 458148 - DNA, 464 bp, Homo sapiens
  misc_feature: HEFZJCU01EDBEG.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaattggggccagggaaccctggtctccgtctcgtcagcctccaccaagggcccatcggtcttcccctcggcgccctgctccaggagcacctccgagagcacagcggccctgggctgcctggtcaaggactacttcccacgagagta

SEQ ID NO: 458149 - DNA, 521 bp, Homo sapiens
  misc_feature: HEFZJCU01BEDOZ.12.86.H09.1.454.heavy.3.raw
  modified_base (380)..(380): a, c, t, g, unknown or other
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttcngtgcgagtcttgatagtagtggttatcctgaatactggggccagggaaccctggtgaccgtctcctcagcctccaccaaggcccatcggtcttcccctgcgccctgctccaggagcacctccgagacgcgacagccggccc

SEQ ID NO: 458150 - DNA, 461 bp, Homo sapiens
  misc_feature: HEFZJCU01BTV8R.40.23.C01.1.454.heavy.3.raw
tctagcgactcacgaccggtgctcgatttagtacacgtgattagggattgggggattcacttttggtgattatgccatgcactgggtccggcaagctccagggaagggcctggagtgggtctcaggtattagttggaatagtggaagtattgactatggggactctgtgaagggccgattcaccatctccagagacaacgccaagaactccctgtatctgcaaatgagcagtctgagagctgaggacacggccttgtattactgtgcaaaagatactaggggaatagtagtgtctcggcggcttggtgcttttgatatctggggccaagggacaatggtcaccgtctcttcagcctccaccaagggcccatcggtcttcccctggcgccctgctccaggagcacctccgagagcacagcggccctgggctgcctggtcaaggactacttccagtcgctaga

SEQ ID NO: 458151 - DNA, 486 bp, Homo sapiens
  misc_feature: HEFZJCU01DPH2F.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccactcggtcttccccctcggcaccctcctccaagagcacctctgggggcgacagcggccctgggctgcctggtcaaggactacttcctagagacacg

SEQ ID NO: 458152 - DNA, 396 bp, Homo sapiens; identical to SEQ ID NO: 444469
  misc_feature: HEFZJCU01EAGNU.47.46.E02.1.454.heavy.3.raw

SEQ ID NO: 458153 - DNA, 495 bp, Homo sapiens; identical to SEQ ID NO: 444618
  misc_feature: HEFZJCU01DNKE3.3.26.C04.1.454.heavy.3.raw

SEQ ID NO: 458154 - DNA, 521 bp, Homo sapiens; identical to SEQ ID NO: 453779
  misc_feature: HEFZJCU01ETEV0.16.10.A10.1.454.heavy.3.raw

SEQ ID NO: 458155 - DNA, 488 bp, Homo sapiens
  misc_feature: HEFZJCU01CCN3J.19.53.E09.1.454.heavy.3.raw
tactctcgtgcacgaccggtgctcgatttagagagagtgtgttggctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctggaggacacggccttgtattactgtgcgaaggaggtatagcacg

SEQ ID NO: 458156 - DNA, 480 bp, Homo sapiens; identical to SEQ ID NO: 445011
  misc_feature: HEFZJCU01BH7PP.22.36.D03.1.454.heavy.3.raw

SEQ ID NO: 458157 - DNA, 487 bp, Homo sapiens
  misc_feature: HEFZJCU01DKSTI.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggcctgggctgcctggtcaggactacttcccatactcgta

SEQ ID NO: 458158 - DNA, 493 bp, Homo sapiens; identical to SEQ ID NO: 450212
  misc_feature: HEFZJCU01B67O8.13.71.G05.1.454.heavy.3.raw

SEQ ID NO: 458159 - DNA, 498 bp, Homo sapiens
  misc_feature: HEFZJCU01DDD13.53.1.A01.1.454.heavy.3.raw
cgcgtatacacacgaccggtgctcgatttagacgtctcatcagggggcatcacataacaaccagattcctcctctaaagaagcccctgggagcacagctcatcaccatggactggacctggaggttcctctttgtggtggcagcagctaccggtgtccagtcccaggtccacctggtgcaatccgggactgaggtgaagaagcctgggtcctcggtgaaggtctcctgcaaggcctctggagacaccttcaacagttatggtatcagttgggtgcgacaggcccctggacaagggcttgagtggatgggaaggatcatcccaatccttggtattacaaaaaatgcacagaggtttcagggcagagtcctgttaaccgcggacaaatccactaccacagtctacatggagctgagcagcctgagatctgaagacacggccctgtactattgtgcgagagaaatgtacttctatgacagtactaatcaatatgctttgat

SEQ ID NO: 458160 - DNA, 520 bp, Homo sapiens
  misc_feature: HEFZJCU01D5JWF.10.53.E09.1.454.heavy.3.raw
catagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccggttcggggccgattcaccatctccaaagacaattgaagaacacgctgttctgcaaatgaacagcctgagagctgaggacacggctgtgtattactgttcgtttggttctgacgtcggtcgggggaacgtaccttcagcacgtgggccgac

SEQ ID NO: 458161 - DNA, 504 bp, Homo sapiens
  misc_feature: HEFZJCU01CCVXA.51.71.G05.1.454.heavy.3.raw
cgatcgtatacacgaccggtgctcgatttagtgtcgtcgcaagagagaggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttccccttcggcaccctcctccaagagcacctctgggggcacagcggccctgggctgcctggtcaaggactactt

SEQ ID NO: 458162 - DNA, 415 bp, Homo sapiens; identical to SEQ ID NO: 444794
  misc_feature: HEFZJCU01BQNYP.14.74.G08.1.454.heavy.3.raw

SEQ ID NO: 458163 - DNA, 500 bp, Homo sapiens
  misc_feature: HEFZJCU01DHJ7K.11.27.C05.1.454.heavy.3.raw
  modified_base (488)..(488): a, c, t, g, unknown or other
cgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatntcggaaccccga

SEQ ID NO: 458164 - DNA, 520 bp, Homo sapiens; identical to SEQ ID NO: 446725
  misc_feature: HEFZJCU01BMIJO.12.86.H09.1.454.heavy.3.raw

SEQ ID NO: 458165 - DNA, 502 bp, Homo sapiens
  misc_feature: HEFZJCU01EZXEL.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagtctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaagacacggctgtgtattactgttcgagacgggctagtctgggatctagttatagtgactcgtcgttctggggccg

SEQ ID NO: 458166 - DNA, 518 bp, Homo sapiens
  misc_feature: HEFZJCU01ENVNM.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatctattgttgttttcgatgccttcggtccgcgggtacttcgtggggccgacgggtaacccg

SEQ ID NO: 458167 - DNA, 516 bp, Homo sapiens
  misc_feature: HEFZJCU01CDG9C.10.59.F04.1.454.heavy.3.raw
catagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtggctccatcaacagtggtgacaactggtggggctgggtccgccagcccccagggatgggactggagtggattggccttacacattatagtgggactacccactacaacccgtccctccaggagtcgagtcaccatctcactagacacgtccaggaatcacctctccctgacggtgacctctgtgaccgccgcggacacggccgtgtattattgtgcgagagaccccgctgaagattcctcaatgtactttgaccactggggccaggggagccctgggtcaccgtctcctcacg

SEQ ID NO: 458168 - DNA, 423 bp, Homo sapiens; identical to SEQ ID NO: 444772
  misc_feature: HEFZJCU01DP5TQ.16.78.H01.1.454.heavy.3.raw

SEQ ID NO: 458169 - DNA, 492 bp, Homo sapiens
  misc_feature: HEFZJCU01DHBAX.4.57.F02.1.454.heavy.3.raw
agcactgtagcacgaccggtgctcgatttagctcgatatagttgggttggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctcgtgggggcacagcggccctgggctgcctggtcaaggactacttccctacagtgct

SEQ ID NO: 458170 - DNA, 525 bp, Homo sapiens
  misc_feature: HEFZJCU01AZ4PV.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctgggccagggaaccctggtcaccgtctcctcagcctccaccaacgggcccatcggtcttccccctggccgccctgcctccaggagcacctccg

SEQ ID NO: 458171 - DNA, 387 bp, Homo sapiens; identical to SEQ ID NO: 444818
  misc_feature: HEFZJCU01C9CN3.11.79.H02.1.454.heavy.3.raw

SEQ ID NO: 458172 - DNA, 535 bp, Homo sapiens; identical to SEQ ID NO: 450524
  misc_feature: HEFZJCU01COIPF.19.10.A10.1.454.heavy.3.raw

SEQ ID NO: 458173 - DNA, 482 bp, Homo sapiens; identical to SEQ ID NO: 444503
  misc_feature: HEFZJCU01CYLEG.7.10.A10.1.454.heavy.3.raw

SEQ ID NO: 458174 - DNA, 379 bp, Homo sapiens; identical to SEQ ID NO: 444450
  misc_feature: HEFZJCU01CB1BM.47.77.G11.1.454.heavy.3.raw

SEQ ID NO: 458175 - DNA, 512 bp, Homo sapiens
  misc_feature: HEFZJCU01BQ7SH.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttccccctggcgccctgctccaggagcacctctgggggcacagcggccctgggctgcctggtcaaggactactcccatac

SEQ ID NO: 458176 - DNA, 523 bp, Homo sapiens
  misc_feature: HEFZJCU01B5TAV.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacgacgggcttctacttctgtgcgagagtaattactatacactgcttcctttttacacctccttgacttctgggccatggacccggt

SEQ ID NO: 458177 - DNA, 553 bp, Homo sapiens
  misc_feature: HEFZJCU01COY9P.49.10.A10.1.454.heavy.3.raw
agtcgagagacacgaccggtgctcgatttagcgtcgatctcagggggggagacgagcccagcactggaagtcgccggtgtttccattcggtgatcatcactgaacacagaggactcaccatggagtttgggctgagctgggtttcctcgctgctcttttaagagacgtccactgttttgttggcctggtggagtctggggggggcgtggtccagcccgggaggtccctcagactctcctgtacagacccgacatcttacgtcaggattaataatgtacactggatccgccaggcccccaggcaaggggctggagtgggtggcattggtgactcatgtggaagacagaaaattgtacgcagactccgtgaggggccgattcatcatctccaaagactactccaagaatacggtgtatcttcaaatgaatggcctcgttttgcggacacggctgtttattattgtgcgacgagggggcccccttccgtacggaggcgatacatactactttgtaccactcggggccgacggggaacccgtcggtcgtaccgtccg

SEQ ID NO: 458178 - DNA, 386 bp, Homo sapiens
  misc_feature: HEFZJCU01CM0PR.43.42.D09.1.454.heavy.3.raw
tgtgagtagtcacgaccggtgctcgatttagacacatacgcagggaaagggctggagtggattggaattatctattatagcgggagcacctactataatccgtccctcaagagtcgagtcaccatatccgtagacacatccaagaaccagttctccctgaggctgagccctgtgaccgccgcagacacggctgtctattactgtgcgacccatcgatatcatgactggttgttagggcacgtctggggccaagggaccacggtcaccgtctcctcagcctccaccaagggcccatcggtcttccccctggcaccctcctccaagagcacctctgggggcacagcggccctgggctgcctggtcaaggactacttccactactcaca

SEQ ID NO: 458179 - DNA, 522 bp, Homo sapiens
  misc_feature: HEFZJCU01CDZHP.47.55.E11.1.454.heavy.3.raw
agctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaaccctggtcagcgtctcctcagcctccaccaagggcccatcggtcttccccctggcgccctgctccaggagcacctccgagagcacagcggccctgggctgcctggtcaac

SEQ ID NO: 458180 - DNA, 519 bp, Homo sapiens; identical to SEQ ID NO: 445330
  misc_feature: HEFZJCU01DFW7W.7.78.H01.1.454.heavy.3.raw

SEQ ID NO: 458181 - DNA, 506 bp, Homo sapiens
  misc_feature: HEFZJCU01CB54R.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggatggcagttgttcatctgaaggagtgttcaatactatacagactccgtgaagggccgattcaccatctccagagacaattccaagaacacgatgtatctgcaaatggacagcctaagagttgaggacacggctgtttattactgtacgaaagaggggggatacgagtggcagctccaagtacttac

SEQ ID NO: 458182 - DNA, 491 bp, Homo sapiens
  misc_feature: HEFZJCU01AYTB0.13.71.G05.1.454.heavy.3.raw
tcacgtactacacgaccggtgctcgatttagtgtcgtcgcaagagagaggaggccagcactaggagtcggcggtgtttccattcggtgatcagcagtgaacacagaggactcaccatggagtttgggctgagctgggttttcctcgttgctcttttaagaggtgtccagtgtcaggtgcagctggtggaatctgggggaggcgtggtccagcctggggaatccctgacactgtcttgtgtagcctctggattcagcttcagaacctatggcatgcactgggtccgccaggccccaggcaaggggctggagtggctgactctttatcatatgatggaagtcaaaaattctatgcagactccgtgaagggccgattcaccgtctccagggacaactccaagaacaccttatatctgcagatgaacagcctgagaggtgacgactcggctgtatacttctgtgcgacaaacatgatgtttggagtggatgtgta

SEQ ID NO: 458183 - DNA, 493 bp, Homo sapiens; identical to SEQ ID NO: 455531
  misc_feature: HEFZJCU01B89D0.47.85.H08.1.454.heavy.3.raw

SEQ ID NO: 458184 - DNA, 515 bp, Homo sapiens
  misc_feature: HEFZJCU01D91MP.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggagggggaaccagcgggagttccaagtactcc

SEQ ID NO: 458185 - DNA, 522 bp, Homo sapiens
  misc_feature: HEFZJCU01C5MMY.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagagtggggcccacggaacgttactacgtctatggacgtctgggggccaagggacccg

SEQ ID NO: 458186 - DNA, 378 bp, Homo sapiens; identical to SEQ ID NO: 444463
  misc_feature: HEFZJCU01CEBPR.47.77.G11.1.454.heavy.3.raw

SEQ ID NO: 458187 - DNA, 483 bp, Homo sapiens; identical to SEQ ID NO: 446587
  misc_feature: HEFZJCU01BHRCE.40.57.F02.1.454.heavy.3.raw

SEQ ID NO: 458188 - DNA, 384 bp, Homo sapiens; identical to SEQ ID NO: 444454
  misc_feature: HEFZJCU01A9PUF.11.61.F06.1.454.heavy.3.raw

SEQ ID NO: 458189 - DNA, 400 bp, Homo sapiens; identical to SEQ ID NO: 444452
  misc_feature: HEFZJCU01A1MPP.47.24.C02.1.454.heavy.3.raw

SEQ ID NO: 458190 - DNA, 540 bp, Homo sapiens
  misc_feature: HEFZJCU01C5CRX.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgtagagcgtcgtctgtcagtggaattgactactggggccgagggaaccctcggtcaccgtctcctcagcctccacccaagggcccg

SEQ ID NO: 458191 - DNA, 481 bp, Homo sapiens; identical to SEQ ID NO: 448054
  misc_feature: HEFZJCU01DDDRA.22.36.D03.1.454.heavy.3.raw

SEQ ID NO: 458192 - DNA, 525 bp, Homo sapiens
  misc_feature: HEFZJCU01E1JX2.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaaccctggtcaccgtctccccaccctccaccaagggcccatcggtcttccccctggcaccctcctccaagagcacctctgggggcacagcggccctgggctgcctggtcaaggactacttcccatactcta

SEQ ID NO: 458193 - DNA, 504 bp, Homo sapiens
  misc_feature: HEFZJCU01EH06S.3.67.G01.1.454.heavy.3.raw
agacgcactccacgaccggtgctcgatttagagtatacatattgggtttggggagctctgggagaggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagcccatgtatttattgtacattaggacactatacg

SEQ ID NO: 458194 - DNA, 502 bp, Homo sapiens
  misc_feature: HEFZJCU01EV5N2.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaaggcccatcggtcttcccctggcaccctcctccaagagcacctctgggggcacagcggccctgggctgcctggtcaaggactacttccgctacgtaga

SEQ ID NO: 458195 - DNA, 525 bp, Homo sapiens; identical to SEQ ID NO: 450208
  misc_feature: HEFZJCU01BLYYA.3.82.H05.1.454.heavy.3.raw

SEQ ID NO: 458196 - DNA, 512 bp, Homo sapiens
  misc_feature: HEFZJCU01ADKFQ.48.57.F02.1.454.heavy.3.raw
agtatacatacacgaccggtgctcgatttagctcgatatagttgggtttggggctgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccaggctccaggaaaaggtctggagtgggtctcagtcatgggtacagctggtcacacatactatgcagactccgtaaagggccgattcaccatctccagagaagacgccaagaattccttgtatcttcagatgaacagtctgagaaccgatgacacggctgtgtattattgtgcaaaggggggagcagctcgtccatccacttcgactcctggggccagggaaccctggtcaccgtctcctcagcctccaccaagggcccatcggtcttccccctggcaccctcctccaagagcacctctc

SEQ ID NO: 458197 - DNA, 530 bp, Homo sapiens
  misc_feature: HEFZJCU01EVAQI.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgacgtactgggggttcggaccccgtggggcccagggaaccctggtcaccgtctcctcagcctccaccg

SEQ ID NO: 458198 - DNA, 498 bp, Homo sapiens
  misc_feature: HEFZJCU01D0WFT.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtgggagtggggtggatcaaccctaccagaggtggcacaaagtatcgacagaactttcagggcagggtcaccatgacctgggacgcgtccatcagcacagtctacatggatctgagcggactgacctctgacgacacggccatgtattacttgtggaagagacgttggtgcgtaccggcggggctgaccacgt

SEQ ID NO: 458199 - DNA, 517 bp, Homo sapiens
  misc_feature: HEFZJCU01DGLYJ.9.70.G04.1.454.heavy.3.raw
  modified_base (501)..(501): a, c, t, g, unknown or other
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctagttaaaactcctactacggtctggacgtntggggccagggaccaa

SEQ ID NO: 458200 - DNA, 509 bp, Homo sapiens; identical to SEQ ID NO: 445415
  misc_feature: HEFZJCU01D9D9S.49.77.G11.1.454.heavy.3.raw

SEQ ID NO: 458201 - DNA, 491 bp, Homo sapiens; identical to SEQ ID NO: 444803
  misc_feature: HEFZJCU01D5XE3.4.57.F02.1.454.heavy.3.raw

SEQ ID NO: 458202 - DNA, 501 bp, Homo sapiens
  misc_feature: HEFZJCU01ECXJ2.13.55.E11.1.454.heavy.3.raw
tcacgtactacacgaccggtgctcgatttagcactcgcacgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcacatctccagagacaacgccaagaactccctgtatctgcaaatgaacagcctgagagctgaggacacggccttgtattatgtgacaaaagataccaccccttacgtt

SEQ ID NO: 458203 - DNA, 505 bp, Homo sapiens
  misc_feature: HEFZJCU01CY1PQ.51.78.H01.1.454.heavy.3.raw
cgatcgtatacacgaccggtgctcgatttagtgtgagtagtttgggtttgggggggagacgagcccagcactggaagtcgccggtgtttccattcggtgatcatcaccgaacacagaggactcaccatggagtttggactgagctgggttttcctcgttgctcttttaagaggtgtccagtgtcaggtgcagctggtggactctgggggaggcgtggtccagcctgggaggtccctgagactctcctgtgcagcctctggattcaccttcaatacttatggcatgcactgggtccgccaggctccaggcaaggggctggagtggctgtcctttatctcatatgatggaggcaacaaaattatgcagactccgtgaagggccgattcaccatctccagagacaattccaagaacactctatatttgcagatgaatagcctgagaattgaggacacggctgtgtattactgtgtgagagggtcggcatattccggtttttggtagtt

SEQ ID NO: 458204 - DNA, 504 bp, Homo sapiens
  misc_feature: HEFZJCU01ESDOL.4.57.F02.1.454.heavy.3.raw
agcactgtagcacgaccggtgctcgatttagctcgatatagttgggtttggggctgggagaggagcccaccagcactagaagtcggcggtgtttccattcggtgatcaccactgaacacagaggactcaccatggagtttgggctgagctgggttttcctcgttgctcttttaagaggtgtccagtgtcaggtgcacctggtggagtcggggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagaagtaagtggtcatggtcctttt

SEQ ID NO: 458205 - DNA, 396 bp, Homo sapiens; identical to SEQ ID NO: 444469
  misc_feature: HEFZJCU01DEVXO.47.46.E02.1.454.heavy.3.raw

SEQ ID NO: 458206 - DNA, 509 bp, Homo sapiens
  misc_feature: HEFZJCU01BEPGP.12.11.A11.1.454.heavy.3.raw
atacgacgtacacgaccggtgctcgatttagctacgactgcaggggaggtctcagagaggagccttagccctggactccaaggcctttccacttggtgatcagcactgagcacagaggactcaccatggaattggggctgagctgggttttccttgttgctatttagaaggtgtccagtgtgaggtgcagctggtggagtctgggggaggcttggtccagcctggggggtccctgagagtctcctgtacaacctctggattcatgtttagtagtcattggatgaactgggtccgccaggctccagggaaggggctggagtgggtggccaacataaaagcaagatggaagtgagaaatactatgtggactctgtgaagggccgattcacaatctccagagacaacgccaagaactcactgtatctgcaaataaacagcctgaaagccgaggacacggctgtgtatttctgtgcgaggacgtcctacggtgacaaatttatcaaaccagac

SEQ ID NO: 458207 - DNA, 505 bp, Homo sapiens; identical to SEQ ID NO: 447076
  misc_feature: HEFZJCU01EF2S6.10.38.D05.1.454.heavy.3.raw

SEQ ID NO: 458208 - DNA, 480 bp, Homo sapiens; identical to SEQ ID NO: 444657
  misc_feature: HEFZJCU01AKB9B.19.67.G01.1.454.heavy.3.raw

SEQ ID NO: 458209 - DNA, 489 bp, Homo sapiens; identical to SEQ ID NO: 444791
  misc_feature: HEFZJCU01AX8BN.47.85.H08.1.454.heavy.3.raw

SEQ ID NO: 458210 - DNA, 491 bp, Homo sapiens; identical to SEQ ID NO: 444592
  misc_feature: HEFZJCU01EVXTK.11.26.C04.1.454.heavy.3.raw

SEQ ID NO: 458211 - DNA, 532 bp, Homo sapiens
  misc_feature: HEFZJCU01BYLOK.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgaccctgggcccgggaaccctggtcaccgtctcctcagcctccaccaagggcccatcggtcttcccctc

SEQ ID NO: 458212 - DNA, 537 bp, Homo sapiens
  misc_feature: HEFZJCU01DIEXI.13.88.H11.1.454.heavy.3.raw
tcacgtactacacgaccggtgctcgatttagcgacagcgagaacacacaaaggggccgggagaggagccccagccctgggattcccaagtgttttcattcagtgatcaggactgaacacagaggactcaccatggagtttgggctgagctggattttccttggtgttttttaaaaggtgtccactgtgagctgcagctggtggagtctggggggggcttggtaaagcctggggggtcccttacactctcctgtgtagcctctaaaatcactttcaacgacgcctggatgagctgggtccgccaggcgccagggaggggactggagtgggttggccgtattaaaagcgaggccgatggtgggacagcagacttcgctgcacccgtgcaagccagattcaccctctcaagacatgatttagagaatactgtgtattgcaaatgaacagcttgacaaccgaggacgcaggcgtttattactgtgccagtagttccacctggccactctacttctttgacttctggggtccagggaaccct

SEQ ID NO: 458213 - DNA, 503 bp, Homo sapiens
  misc_feature: HEFZJCU01D0O7M.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtgggtgggtcagcggctttgacggtaaggcacagtatgcaccgaagatgaagggcagagtcacgattaccacggaccacccccacgaacacagtctacatgcaactgacgagcctgagagctagacgacacggccgtctattactgtgcgagaatgttttctgtcatcgtacaatttgataggctctatggactggacttcgtc

SEQ ID NO: 458214 - DNA, 492 bp, Homo sapiens
  misc_feature: HEFZJCU01C6ONF.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactccgtggggccagggaaccctggtcatcgtctcctcagcctccaccaagggcccatcggtcttcccctggcgccctgctccaggacgcaccctccgagagcacagcggccctgggctgcctggtcaaggactacttcctacgtgagct

SEQ ID NO: 458215 - DNA, 516 bp, Homo sapiens
  misc_feature: HEFZJCU01DU0MI.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctcccagcctccaccaagggcccatcggtccttcccc

SEQ ID NO: 458216 - DNA, 511 bp, Homo sapiens; identical to SEQ ID NO: 446799
  misc_feature: HEFZJCU01EKJ57.18.39.D06.1.454.heavy.3.raw

SEQ ID NO: 458217 - DNA, 537 bp, Homo sapiens
  misc_feature: HEFZJCU01CVUN2.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccgaagggacgctggtcaccgtctcttcagcctccaccaagggcccatcggtcttcccctgcaccctcctccaagagcacctctgggggcacagcc

SEQ ID NO: 458218 - DNA, 528 bp, Homo sapiens
  misc_feature: HEFZJCU01DG2UM.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaagagggggatacagtggcagctccaagtactactttgactttctggggccagggaaccctggtcaccgtctcctcagcctccaccaagggcccatcggtcttccccctggcgccctgctccaggagcacctccgagacg

SEQ ID NO: 458219 - DNA, 526 bp, Homo sapiens
  misc_feature: HEFZJCU01DOFAL.47.6.A06.1.454.heavy.3.raw
agctcacgtacacgaccggtgctcgatttagatctactgacagcacacaaggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctccctgaagttgaactcagtgaccgctgcggacacggccgtgtattactgtgcgagccacaccgattacgatttttggagtggccttgataactggggccaggggatccgtggtcaccgtctcctcacgcctccaccaac

SEQ ID NO: 458220 - DNA, 504 bp, Homo sapiens
  misc_feature: HEFZJCU01CK0O6.52.61.F06.1.454.heavy.3.raw
  modified_base (392)..(392): a, c, t, g, unknown or other
cgcagtacgacacgaccggtgctcgatttagctacgctctaagggaaaggggacccaacaaccacatccctcctcagaagcccccagagcacaacgcctcaccatggactggacctggaggatcctctttttggtggcagcagccacaggtgcccactcccaggtccaaattgtgcagtctggggctgaggtgaagaagcctggggcctcagtgaaggtttcctgcaaggcttctggatacagtttcactaggtattcgatgcattggctgcgccaggcccccggacaaaggcctgagtggatgggaagtctcagtgatggcaaaggtgacaaaaagtattcacagaagttccagggcagagtcaccattaccagcgacgcatccgcgaacncagcctatatggaactcagcagcctgagatctgaagacacggctgtctattactgtgcgagggtcggcacgctgacaacctcttacttctattcctacgctatggacgtctc

SEQ ID NO: 458221 - DNA, 502 bp, Homo sapiens
  misc_feature: HEFZJCU01B0Q9W.13.33.C11.1.454.heavy.3.raw
tcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgttattattgtgcaataagaattgcaaacgatgcttttgatatgtggggccaagggacacg

SEQ ID NO: 458222 - DNA, 500 bp, Homo sapiens; identical to SEQ ID NO: 448262
  misc_feature: HEFZJCU01ET4T3.7.85.H08.1.454.heavy.3.raw

SEQ ID NO: 458223 - DNA, 523 bp, Homo sapiens
  misc_feature: HEFZJCU01EFS7G.12.40.D07.1.454.heavy.3.raw
  modified_base (357)..(357): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttanctgcaaatagacagcctgagaccagacgacacggctgtctattattgcgcgagagagacacacgaacctactggccaatactatgggggcttgttctgggggccaggggaccctggtcatcgtctccccagcctccaccaagggcccatcggtcttcccctggccg

SEQ ID NO: 458224 - DNA, 506 bp, Homo sapiens
  misc_feature: HEFZJCU01C7AIS.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaaggcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgtatccggtgagcctacggcagcggcctttgacttcgtc

SEQ ID NO: 458225 - DNA, 510 bp, Homo sapiens
  misc_feature: HEFZJCU01BV6DK.9.14.B03.1.454.heavy.3.raw
tgatacgtctcacgaccggtgctcgatttagtgtgagtagtttgggtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttccccctggcgccctgctccaggagcacctccgagagcacagcggccctgggctgcctggtcaaggactacttccagacgtatca

SEQ ID NO: 458226 - DNA, 519 bp, Homo sapiens; identical to SEQ ID NO: 447510
  misc_feature: HEFZJCU01EO5OV.10.79.H02.1.454.heavy.3.raw

SEQ ID NO: 458227 - DNA, 461 bp, Homo sapiens
  misc_feature: HEFZJCU01EG38A.51.5.A05.1.454.heavy.3.raw
cgatcgtatacacgaccggtgctcgatttagatagatagacaggggaccttcctgccagacaccacctcagcccctcctggaagggacaggagcgcgcaagggtgagtcagaccctcctgccctcgatggcaggtggagaagattcagaaaggtctgagatccccgggacgcagcaccactgtcaatgggggccccagacgcctggaccagggcctgcgtgggaaaggcctctgggcacactcaggggctttttgtgaagggtccgcctactgtgtgactacggtaaatacgttaattcttctactacgatatggacgtctggggccaagggaccacggtcaccgtctcttcagcctccaccaagggcccatcggtcttccccctggcaccctcctccaagagcacctctggggcacagcggcctgggctgcctggtcaaggactacttcctcgtagcact

SEQ ID NO: 458228 - DNA, 506 bp, Homo sapiens; identical to SEQ ID NO: 446520
  misc_feature: HEFZJCU01B6IA8.10.38.D05.1.454.heavy.3.raw

SEQ ID NO: 458229 - DNA, 539 bp, Homo sapiens
  misc_feature: HEFZJCU01AP3S8.48.40.D07.1.454.heavy.3.raw
agtatacatacacgaccggtgctcgatttagtgatagagcgtaacaacagagggggagccccagacctgggattcccagctgtttctgcttgctgatcaggaccgcacacagagagctcaccatggagttggggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactgggtccgccaagctccagggaaggggctggagtgggtctcaaacgtgaacgttgatggcgggatcacaaatacgcggactccgtgaaaggccgcttcaccgtctccagagacaacggcgagaatactctgtatttgcagatgagaaatctgagaggcgaggacaccgcgctttattattgtacaacgtcgttttacttttctaatggtggctcttacgaacgacatgactattggggtcggggaaccctggtcc

SEQ ID NO: 458230 - DNA, 395 bp, Homo sapiens; identical to SEQ ID NO: 444517
  misc_feature: HEFZJCU01EHVQW.16.68.G02.1.454.heavy.3.raw

SEQ ID NO: 458231 - DNA, 385 bp, Homo sapiens; identical to SEQ ID NO: 456553
  misc_feature: HEFZJCU01CWNX4.18.60.F05.1.454.heavy.3.raw

SEQ ID NO: 458232 - DNA, 382 bp, Homo sapiens
  misc_feature: HEFZJCU01D5FWJ.48.42.D09.1.454.heavy.3.raw
agtatacatacacgaccggtgctcgatttagacacatacgcagggaaaggggctggagtggattgggagtatgcactatagtgggagcacccactacaccccgtccctcaagagtcgagtcaccatatccgtagacacgtccaagaatcagttctccctgaagctgacctctgtgaccgccgcagacacggctgtttattactgtgtgagacgggtgccccaagaaaagtgttttatccctggggccagggaaccctggtcaccgtctcctcagcctccaccaagggcccatcggtcttccccctggcaccctcctccaagagcacctctggggcacagcggccctgggctgcctggtcaaggactacttcctatgtatact

SEQ ID NO: 458233 - DNA, 497 bp, Homo sapiens; identical to SEQ ID NO: 450432
  misc_feature: HEFZJCU01CNK0M.40.34.D01.1.454.heavy.3.raw

SEQ ID NO: 458234 - DNA, 499 bp, Homo sapiens; identical to SEQ ID NO: 452982
  misc_feature: HEFZJCU01DDPHX.11.71.G05.1.454.heavy.3.raw

SEQ ID NO: 458235 - DNA, 510 bp, Homo sapiens
  misc_feature: HEFZJCU01BODFF.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatcctccagagacaattccaagaacacactgtatctgcaaatgaacagcctgagagccgacgacacggccatatattactgtgcgaaagcaccggcagttagtcacccatactactttgactactggggcc

SEQ ID NO: 458236 - DNA, 396 bp, Homo sapiens; identical to SEQ ID NO: 444469
  misc_feature: HEFZJCU01A4QG5.47.46.E02.1.454.heavy.3.raw

SEQ ID NO: 458237 - DNA, 486 bp, Homo sapiens; identical to SEQ ID NO: 454595
  misc_feature: HEFZJCU01AGAZZ.16.12.B01.1.454.heavy.3.raw

SEQ ID NO: 458238 - DNA, 485 bp, Homo sapiens
  misc_feature: HEFZJCU01CIHOE.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtgcgtttattcgaagcgatgggactcatgaacaatatgcagactccgtgaaggccgattcatcatctccagagacaactccaacaacacactggatctccaaatgaacagcctgagagtcgaggacacggccgtatattattgtgcccttgattacta

SEQ ID NO: 458239 - DNA, 526 bp, Homo sapiens
  misc_feature: HEFZJCU01A311A.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacgttcca

SEQ ID NO: 458240 - DNA, 528 bp, Homo sapiens
  misc_feature: HEFZJCU01BHSR4.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtcctcaagagtcgagtaacgatctcagtggacacgtctaacaatcacctctccctgaggctgagctctgtgacagccgcggacacgggcgtttattactgtgcgagaggggacggacgtacggtgactacgtgggggttcgacccctggggccaggggaaccctggtcaccgtctcctcagcctcaccg

SEQ ID NO: 458241 - DNA, 510 bp, Homo sapiens
  misc_feature: HEFZJCU01ECHJK.52.27.C05.1.454.heavy.3.raw
cgcagtacgacacgaccggtgctcgatttagacgcgatcgaagggtttgggaccggtgctcgattcagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttcccctggcaccctcctccaagagcactcg

SEQ ID NO: 458242 - DNA, 500 bp, Homo sapiens; identical to SEQ ID NO: 445080
  misc_feature: HEFZJCU01EZ5FA.3.81.H04.1.454.heavy.3.raw

SEQ ID NO: 458243 - DNA, 498 bp, Homo sapiens
  misc_feature: HEFZJCU01EP7A4.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctgggctgcctggtcaaggactaccg

SEQ ID NO: 458244 - DNA, 469 bp, Homo sapiens
  misc_feature: HEFZJCU01EMAK9.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctgcgcctgctccagagcacctccgagagcacacgcggcccgtgggctgcctggtcaaggactacttccctacagtgct

SEQ ID NO: 458245 - DNA, 535 bp, Homo sapiens
  misc_feature: HEFZJCU01DCRFC.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgagttggccgtattaaaaccaaaactgatggtgggacaacagactacgctgcacccgtgaaaggcagattcaccatctcaagagatgattcaaaaagcacgctgtatctgcaaatgaacagcctgagaaccgaggacacagccgtgtattactgtaccacatcccctgaaagcgtcaactactactactacggtatggacctctgggccaac

SEQ ID NO: 458246 - DNA, 526 bp, Homo sapiens
  misc_feature: HEFZJCU01B8DB2.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaagggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttccacg

SEQ ID NO: 458247 - DNA, 498 bp, Homo sapiens
  misc_feature: HEFZJCU01BD9CK.11.71.G05.1.454.heavy.3.raw
  modified_base (471)..(471): a, c, t, g, unknown or other
cgagagataccacgaccggtgctcgatttagtgtcgtcgcaagagagaggagcccagcactagaagtcggcggtgtttccattcggtgatcagcactgaacacagaggactcaccatggagtttgggctgagcggtcggtttcgtcgtaggcgtctttaagtaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatatgcaaatgaacagcctgagagccgaggacacggccgtatatttctgtgcgaaagntcgggcatatagtgcctacgcctgggg

SEQ ID NO: 458248 - DNA, 518 bp, Homo sapiens
  misc_feature: HEFZJCU01DQITB.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaatgaacagcctaagtcctgaggacacgggtgtatactactgtacgaagggaggggggaaccaggcgggagtccaagtacttccg

SEQ ID NO: 458249 - DNA, 507 bp, Homo sapiens; identical to SEQ ID NO: 446906
  misc_feature: HEFZJCU01A53KF.52.34.D01.1.454.heavy.3.raw

SEQ ID NO: 458250 - DNA, 488 bp, Homo sapiens; identical to SEQ ID NO: 447044
  misc_feature: HEFZJCU01A5AM9.18.70.G04.1.454.heavy.3.raw

SEQ ID NO: 458251 - DNA, 529 bp, Homo sapiens
  misc_feature: HEFZJCU01EX8YS.16.27.C05.1.454.heavy.3.raw
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactacgtggggccggggagccccggtcatcgtctccc

SEQ ID NO: 458252 - DNA, 395 bp, Homo sapiens; identical to SEQ ID NO: 445227
  misc_feature: HEFZJCU01AM1BC.47.46.E02.1.454.heavy.3.raw

SEQ ID NO: 458253 - DNA, 525 bp, Homo sapiens
  misc_feature: HEFZJCU01CJPSN.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgccctgctccaggagcacctccgagagcacagcggccctcggg

SEQ ID NO: 458254 - DNA, 513 bp, Homo sapiens; identical to SEQ ID NO: 446699
  misc_feature: HEFZJCU01EE34F.12.25.C03.1.454.heavy.3.raw

SEQ ID NO: 458255 - DNA, 489 bp, Homo sapiens
  misc_feature: HEFZJCU01CNGJU.51.35.D02.1.454.heavy.3.raw
cgatcgtatacacgaccggtgctcgatttagcacacgatagttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggcttctttttactgtgcgccagaagca

SEQ ID NO: 458256 - DNA, 507 bp, Homo sapiens
  misc_feature: HEFZJCU01BS9HG.11.72.G06.1.454.heavy.3.raw
cgagagataccacgaccggtgctcgatttagctacgactgcaagggaaaggggacccaaaaaccacacccctccttgggagaatcccctagatcatagctcctcaccatggactggacctggagcatccttttcttggtggcagcagcaacaggtgcccactcacagggtcaactggtgcagtctggacctgaggtgaagaagcctggggcctcagtgaaggtctcctgtaaggcctcaggttacaccttcaccgctaatggtatcacctggcttcgacaggcccctggacaaggacttgagtgggtgggatggatcaactctcacactggaagcagagtctatgcggagagattccagggcagagtcaccctgaccacagagacatccacgaccacagtctacatggagctgtggagcctgagacctgacgacacggccctctattactgtgcgaggccctatcctacagtgaccactccacgctggttcgacctctcggggccac

SEQ ID NO: 458257 - DNA, 519 bp, Homo sapiens
  misc_feature: HEFZJCU01CO8MT.15.16.B05.1.454.heavy.3.raw
tctacgtagccacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccaggggaaccctggtctaccg

SEQ ID NO: 458258 - DNA, 520 bp, Homo sapiens; identical to SEQ ID NO: 447654
  misc_feature: HEFZJCU01AD0V1.10.79.H02.1.454.heavy.3.raw

SEQ ID NO: 458259 - DNA, 510 bp, Homo sapiens
  misc_feature: HEFZJCU01DDG19.48.86.H09.1.454.heavy.3.raw
agtatacatacacgaccggtgctcgatttagtgctatagacttgggtttggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccaaggggacaatggtcaccgtctcttcagcctccaccaacggg

SEQ ID NO: 458260 - DNA, 509 bp, Homo sapiens
  misc_feature: HEFZJCU01EKJTV.52.83.H06.1.454.heavy.3.raw
cgcagtacgacacgaccggtgctcgatttagatcacgtgcgtcgcggggctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctgggggaggcgtggtccagcctgggaggtccctgagactctcctgtgtagcctctggattcaccttcagggtctatgacatgcactgggtccgccaggctccaggcaaggggctggagtgggtggcatttatatcaaatgatggaagtaacaaatactatgtagactccgtgaagggccgattcaccatctccagagacaattccaagaatacgctgtatctgcacatgaacagcctgagagccgaagacacgggtgtttattactgtgcgaacttaattacggagacaacggtaaccccgtcgaccg

SEQ ID NO: 458261 - DNA, 510 bp, Homo sapiens
  misc_feature: HEFZJCU01AP9LX.13.76.G10.1.454.heavy.3.raw
  modified_base (466)..(466): a, c, t, g, unknown or other
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagnagtcggacctaccgtacggtaccacgtattatttttggacgttc

SEQ ID NO: 458262 - DNA, 517 bp, Homo sapiens
  misc_feature: HEFZJCU01BZCBD.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggccatcggtcttcccctggcaccctcctccaagagcacctctgggggcacagcggccctgggctgcctggtcaaggactacttccagacgtatca

SEQ ID NO: 458263 - DNA, 513 bp, Homo sapiens
  misc_feature: HEFZJCU01DI81V.40.21.B10.1.454.heavy.3.raw
tctagcgactcacgaccggtgctcgatttagtgtcgtcgcaagggggtctcagagaggagccttagccctggactccaaggcctttccacttggtgatcagcactgagcacagaggactcaccatggaattggggctgagctgggttttccttgttgccattttagaaggtgtccagtgtgaggtgcagttggtggagtcggggggagacttggtccaggctggggggtccctgagactctcctgtgcagcctctggattcagctttagtaggtattggatgagctgggtccgccaggctccagggaagggactggagtggatggccaacataaagggaagacggaagtgacaaaaagtatgtggactctgtgagcggccgatttaccatctccagagacaacgccaagaactcactgtatctgcaaatgaacaacctgagagccgaggacacggctgtgtattactgtgtgagagatttcagtcccgatttgtagtggtgcaggtgcttacg

SEQ ID NO: 458264 - DNA, 409 bp, Homo sapiens; identical to SEQ ID NO: 444519
  misc_feature: HEFZJCU01C41AW.3.41.D08.1.454.heavy.3.raw

SEQ ID NO: 458265 - DNA, 489 bp, Homo sapiens; identical to SEQ ID NO: 444791
  misc_feature: HEFZJCU01AC6WR.47.85.H08.1.454.heavy.3.raw

SEQ ID NO: 458266 - DNA, 515 bp, Homo sapiens; identical to SEQ ID NO: 447834
  misc_feature: HEFZJCU01EFHRJ.3.20.B09.1.454.heavy.3.raw

SEQ ID NO: 458267 - DNA, 511 bp, Homo sapiens
  misc_feature: HEFZJCU01D8SOH.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagagtggggcccacgaacgttactacgctatggacgtctgggg

SEQ ID NO: 458268 - DNA, 529 bp, Homo sapiens
  misc_feature: HEFZJCU01CXA35.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtgggggcatttacttgaccctggggccggggaaccctggtcaccgtctccccaccctccaccg

SEQ ID NO: 458269 - DNA, 514 bp, Homo sapiens
  misc_feature: HEFZJCU01BMK81.52.83.H06.1.454.heavy.3.raw
cgcagtacgacacgaccggtgctcgatttagatcacgtgcgtcgcgggtctctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtctggggggaggcgtggtccagcctgggaggtccctgagactctcctgtgtagcctctggattcaccttcagggtctatgacatgcactgggtccgccgaggctccaggcaaggggctggagtgggtggcatttatatcaaatgatggaagtaacaaatactatgtagactccgtgaagggccgatcaccatctccagagacaattccaagaatacgctgtatctgcacatgaacagcctgagagccgaagacacggggtgtttattactgtgcgaacttaattacggaggacaacggtaacccccgtcccgg

SEQ ID NO: 458270 - DNA, 523 bp, Homo sapiens; identical to SEQ ID NO: 450286
  misc_feature: HEFZJCU01ENMYS.9.78.H01.1.454.heavy.3.raw

SEQ ID NO: 458271 - DNA, 423 bp, Homo sapiens; identical to SEQ ID NO: 444772
  misc_feature: HEFZJCU01CFQSK.16.78.H01.1.454.heavy.3.raw

SEQ ID NO: 458272 - DNA, 519 bp, Homo sapiens
  misc_feature: HEFZJCU01A4OYS.12.11.A11.1.454.heavy.3.raw
  modified_base (467)..(467): a, c, t, g, unknown or other
atacgacgtacacgaccggtgctcgatttagctacgactgcaggggaggtctcagagaggagccttagccctggactccaaggcctttccacttggtgatcagcactgagcacagaggactcaccatggaattggggctgagcgtggtttcgtgtagctatttagtaaggtgtccagtgtgaggtgcagctggtggagtctgggggaggcttggtccagcctggggggtccctgagagtctcctgtacaacctctggattcatgtttagtagtcattggatgaactgggtccgccaggctccagggaaggggctggagtgggtggccaacataaagcaagatggaagtgagaaatactatgtggactctgtgaagggccgattcacaatctccagagacaacgccaagaactcactgtatctgcaaataaacagcctgaaagccgaggacacggctgtgtattttcngttgcgaggacgtcctaggtgacaaatttattcgaaaccagacaaagtttcg

SEQ ID NO: 458273 - DNA, 489 bp, Homo sapiens
  misc_feature: HEFZJCU01B8SDT.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctgggtcaccatgaccagcgacacatctagcaacacagtctacatggagttgaccagcctgaccgacacggccgtgtattttgtgtgagagattttcggacaatccagagacccctgtc

SEQ ID NO: 458274 - DNA, 385 bp, Homo sapiens
  misc_feature: HEFZJCU01EJSJP.18.60.F05.1.454.heavy.3.raw
tacgagtatgcacgaccggtgctcgatttagtacgtcatcagggaaaggggctggaatatattgggattacctcttacagtgggaccacccattacaacccgtccctcaaaagtcgactcaccatttccgtggacacgtcgaaaacgagttctccctggacttgacctctgtgaccgccgcagacacggctgtttattactgtgcgagacgactacctgactccaatccatactttgactattggggccggggagccctggtcaccgtctcctcagcctccaccaagggcccatcggtcttccccctggcaccctcctccaagagcacctctgggggcacagcggccctgggctgcctggtcaaggactacttcccatactcgta

SEQ ID NO: 458275 - DNA, 508 bp, Homo sapiens
  misc_feature: HEFZJCU01B32ON.22.70.G04.1.454.heavy.3.raw
acatacgcgtcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtcctcaagagtcgagtcagcatgtcagtcgacacgtcccagaaccagttctccctgacagtgagttatatgaccgccgcagacacggccgtgtattactgtgcgagagaggccgttattttaggtaccagctgttaaaaactcctactacggtctggacgtctggggcc

SEQ ID NO: 458276 - DNA, 509 bp, Homo sapiens
  misc_feature: HEFZJCU01BD6WB.49.72.G06.1.454.heavy.3.raw
agtcgagagacacgaccggtgctcgatttagctacgactgcaagggaaagggtctgtgaagccttcacagaccctgtccctcacctgcgctgtctctggtggctccatcaccagtggtggttattcctggacttggatccggcagccaccagggaaggccctggagtggattgggcacatctatcatagtgggaccacctactacaacccgtccctccagagtcgagtcaccatatcagtcgacatgtccgagaaccagttctccctgtacctccactctgtgaccgccgcggacacggccgtctattactgtgccagaggggaactctacttcggggagttaggaatcgctcctgcatttgacatctggggccagggaaacctgggtcaccgtctcctcagcctccaccaagggcccatcggtcttccccctggcaccctcctccaagagcacctctgggggcacagcggcctgggctgcctggtcaaggactactcctctctcgact

SEQ ID NO: 458277 - DNA, 505 bp, Homo sapiens
  misc_feature: HEFZJCU01D40C0.10.38.D05.1.454.heavy.3.raw
catagtagtgcacgaccggtgctcgatttagtatctgatagttgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctggcgcctgctccaggagcacctccgagagcacagcgcccgtgggctgcctc

SEQ ID NO: 458278 - DNA, 519 bp, Homo sapiens
  misc_feature: HEFZJCU01EJ03B.52.78.H01.1.454.heavy.3.raw
cgcagtacgacacgaccggtgctcgatttagtgtgagtagtttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttcccctggcaccctcctccaagagcacctctgggggcacagcggccctgggctgcctggtcaaggactacttcctatacgta

SEQ ID NO: 458279 - DNA, 490 bp, Homo sapiens
  misc_feature: HEFZJCU01CF3GC.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctgggctgcctggtcgaaggactacttcccatactcgta

SEQ ID NO: 458280 - DNA, 485 bp, Homo sapiens
  misc_feature: HEFZJCU01CN8YU.11.23.C01.1.454.heavy.3.raw
cgagagataccacgaccggtgctcgatttagtacacgtgattagggattgggggcagggtgtacacctgtggttctcggggctgccctttggctttggagatggttttctcgatggggggctggagtggcttggggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttggacgtctggggccaagggaccacggtcatcgtctcctcagcctccaccaagggcccatcggtcttcccctcggcaccctcctccaagagcacctctggggcacagcggccctgggctgcctggtcaaggactacttccgtatctctcg

SEQ ID NO: 458281 - DNA, 488 bp, Homo sapiens
  misc_feature: HEFZJCU01BKJWX.49.8.A08.1.454.heavy.3.raw
agtcgagagacacgaccggtgctcgatttagcatactctacgtagggggagctctgggagaggagcccagcactagaagtcggcggtgtttccattcggtgatcagcactgaacacagaggactcaccatggagtttgggtctgagctgggttttccttcgttgctcttttaagtaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagcaatatatactatgtagactccgtgaagggccgattcatcatctccagagacaattccgagaacacgctgtatctgcaaatgaacagcctagagagctggaagacgacggctgtgtattactgtgcgaacttt

SEQ ID NO: 458282 - DNA, 449 bp, Homo sapiens
  misc_feature: HEFZJCU01DJ8FE.10.38.D05.1.454.heavy.3.raw
catagtagtgcacgaccggtgctcgatttagtatctgatagttgggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctgggccagggagcccaggtcaccgtctccccagcctccaccaagggcccatcggtcttccccctggcgccctgctccaggagcacctccgagagcacagcggccctgggctgcctggtcaaggactacttcccactactatg

SEQ ID NO: 458283 - DNA, 512 bp, Homo sapiens
  misc_feature: HEFZJCU01DC30D.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactacttttgactactggggccg

SEQ ID NO: 458284 - DNA, 508 bp, Homo sapiens
  misc_feature: HEFZJCU01AP3QD.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgaggggccgattcaccatctccagagacgattccaagaacacgttgtatcttcaaatgaacagcctgacagtcgacgacacggccatgttatttttgtgcgagcgacccggggctcctcaatggctttcattacg

SEQ ID NO: 458285 - DNA, 392 bp, Homo sapiens
  misc_feature: HEFZJCU01DVTS8.49.42.D09.1.454.heavy.3.raw
agtcgagagacacgaccggtgctcgatttagacacatacgcagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctggactgcctggtcaaggactacttcctctctcgct

SEQ ID NO: 458286 - DNA, 506 bp, Homo sapiens
  misc_feature: HEFZJCU01ELLSQ.13.37.D04.1.454.heavy.3.raw
tcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactacactttttgactactggggccagggaaccctggtcaccgtctcttcagcctccaccaagggcccatcggtcttcccctggccaccctcctccaagagcacctctgggggcacagcggccctggctgcctggtcaaggactacttcctagtacgtga

SEQ ID NO: 458287 - DNA, 522 bp, Homo sapiens
  misc_feature: HEFZJCU01EWOTB.47.6.A06.1.454.heavy.3.raw
agctcacgtacacgaccggtgctcgatttagatctactgacagcacacaagggggggaaatactttctgagagtcctggacctcctgtgcaagaacatgaaacatctgtggttcttccttctcctggtggcagctcccacatgggtcctgtcccaggtgcagctgcaggagtcgggcccaggactggtgaagccttcggagaccctgtccctcacttgcactgtctctggtggctccatcaggagttactactggacctggcttcggcagtccccagggaagggactggagtggattgggtataattattacagtgggaccaccaactacaacccctccctcaagagtcgagtcaccatatcaatagacacgtcgaagaaccagttctcctgaagttgaactcagtgacgctgcggacacggccgtgtattactgtgcgagccacaccgattacgattttggagtggccttgataactggggccaggggatcctggtcaccgtctcctcagcctccaccaac

SEQ ID NO: 458288 - DNA, 484 bp, Homo sapiens; identical to SEQ ID NO: 445311
  misc_feature: HEFZJCU01EA27C.11.23.C01.1.454.heavy.3.raw

SEQ ID NO: 458289 - DNA, 391 bp, Homo sapiens; identical to SEQ ID NO: 446378
  misc_feature: HEFZJCU01APOB8.16.24.C02.1.454.heavy.3.raw

SEQ ID NO: 458290 - DNA, 538 bp, Homo sapiens
  misc_feature: HEFZJCU01B7F0N.52.9.A09.1.454.heavy.3.raw
cgcagtacgacacgaccggtgctcgatttagcgagacgcgcagggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatgaaaactacgcccctggcgctatggacgtctggggccaagggaccacggtcaccgtctcctcagcctccaccaagggcccatcggtcttcccctc

SEQ ID NO: 458291 - DNA, 520 bp, Homo sapiens
  misc_feature: HEFZJCU01CIN6W.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaacctggtcaccgtctcctcagcctccaccaagggcccatcggtcttccccctcggcaccctcctccaagagcacctctgggggcacagcggccctgggctgcctggtcaaggactacttccgagtagtacac

SEQ ID NO: 458292 - DNA, 511 bp, Homo sapiens; identical to SEQ ID NO: 445840
  misc_feature: HEFZJCU01ALSXS.11.13.B02.1.454.heavy.3.raw

SEQ ID NO: 458293 - DNA, 508 bp, Homo sapiens
  misc_feature: HEFZJCU01BINNT.40.31.C09.1.454.heavy.3.raw
tctagcgactcacgaccggtgctcgatttagacgtctcatcaaggaaggaagggggcttttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccgaagggacaaatggtcaccg

SEQ ID NO: 458294 - DNA, 393 bp, Homo sapiens
  misc_feature: HEFZJCU01DROKM.47.59.F04.1.454.heavy.3.raw
agctcacgtacacgaccggtgctcgatttagtacacacacttagggagggggctggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatggggctcaaaccaatttttcactactggggccagggatccctggtcgccgtcggctcagcctccaccaagggcccatcggtcttcccctggcgccctgctccaggagcacctccgagagcacagcggccctgggctgcctggtcaaggactacttcctacgtgagct

SEQ ID NO: 458295 - DNA, 505 bp, Homo sapiens
  misc_feature: HEFZJCU01CCU27.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcgtgggttttccgtcgttaggctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaatttccaggcacacgctgtatctgcaaatgaacagcctgagagctgaggacacggctgtgtattactgttgcgaaagattttctatagaggtgactac

SEQ ID NO: 458296 - DNA, 520 bp, Homo sapiens; identical to SEQ ID NO: 453029
  misc_feature: HEFZJCU01C9SGY.16.86.H09.1.454.heavy.3.raw

SEQ ID NO: 458297 - DNA, 485 bp, Homo sapiens
  misc_feature: HEFZJCU01EGME3.12.75.G09.1.454.heavy.3.raw
atacgacgtacacgaccggtgctcgatttagtatagacatcagggggcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcagggccctcccgacatcggttta

SEQ ID NO: 458298 - DNA, 512 bp, Homo sapiens
  misc_feature: HEFZJCU01BNTGA.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggttaaggactacttccgagtgcgtct

SEQ ID NO: 458299 - DNA, 487 bp, Homo sapiens
  misc_feature: HEFZJCU01D9XGF.48.53.E09.1.454.heavy.3.raw
agtatacatacacgaccggtgctcgatttagagagagtgtgttgggtttgggggcatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggcccgtctatttattgttccagagataatcgcgtgaataaagat

SEQ ID NO: 458300 - DNA, 506 bp, Homo sapiens; identical to SEQ ID NO: 444696
  misc_feature: HEFZJCU01ERB6B.16.34.D01.1.454.heavy.3.raw

SEQ ID NO: 458301 - DNA, 501 bp, Homo sapiens
  misc_feature: HEFZJCU01AWLU0.13.85.H08.1.454.heavy.3.raw
tcacgtactacacgaccggtgctcgatttagtatcactcagtacgcggggagcatcatccaacaaccacatcccttctctacagaagcctctgagaggaaagttcttcaccatggactggacctggagggtcttctgcttgctggctgtagctccaggtgttcatacccaggtacaactggtgcaatctggggctgaggtgacgaagcctggggcctcagtgaagctttcctgcaagtcatctgggtacagcttcaccagccactacatgcactgggtccgacaggcccctgggcaaggtcttgagtggatgggactaatcactcccaatggtgatgggactgcctacgcacagaagtttcagggcagagtcaccatgaccagggacacgtccacgagaacagactatttggagttgagcagcctgagatctgacgacacggccgtttattactgtgcgcgagataatagtcacaactggaacggcgttttgggggtgttc

SEQ ID NO: 458302 - DNA, 509 bp, Homo sapiens; identical to SEQ ID NO: 453913
  misc_feature: HEFZJCU01E0V99.22.82.H05.1.454.heavy.3.raw

SEQ ID NO: 458303 - DNA, 470 bp, Homo sapiens; identical to SEQ ID NO: 444866
  misc_feature: HEFZJCU01EHTUW.4.36.D03.1.454.heavy.3.raw

SEQ ID NO: 458304 - DNA, 481 bp, Homo sapiens
  misc_feature: HEFZJCU01DYX30.49.53.E09.1.454.heavy.3.raw
agtcgagagacacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcga

SEQ ID NO: 458305 - DNA, 382 bp, Homo sapiens
  misc_feature: HEFZJCU01CA50W.47.77.G11.1.454.heavy.3.raw
agctcacgtacacgaccggtgctcgatttagctagtcactcaagggaaaggggctggagtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaaccctggtcagcgtctcctcagcctccaccaagggcccatcggtcttccccctggcgccctgctccaggagcacctccgagagcacagcggccctgggctgcctggtcaaggactacttcctacgtgagct

SEQ ID NO: 458306 - DNA, 532 bp, Homo sapiens
  misc_feature: HEFZJCU01ACUCD.12.71.G05.1.454.heavy.3.raw
  modified_base (466)..(466): a, c, t, g, unknown or other
  modified_base (479)..(479): a, c, t, g, unknown or other
  modified_base (482)..(482): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtctacatatttcgacccctggggccagggaacccaggtcaccgtctcctcagcctccaccaagggcccatccgtcttcccctgcgccctgctccaggancacctccgaggancanggccgccgtggctcgccgtacggtacgaacggtacttacctccgttaccg

SEQ ID NO: 458307 - DNA, 519 bp, Homo sapiens; identical to SEQ ID NO: 444867
  misc_feature: HEFZJCU01AEVHM.9.34.D01.1.454.heavy.3.raw

SEQ ID NO: 458308 - DNA, 405 bp, Homo sapiens
  misc_feature: HEFZJCU01EJ3M5.16.72.G06.1.454.heavy.3.raw
tgtactactccacgaccggtgctcgatttagctacgactgcaagggaaaggggctggagtgggtctcatctattagtagtagtgatagtgccacatactacgcagactccgtgaagggccggttcaccatctccagagatagatccaagaacacgctgtatctgcaaatggacagcctgagagccgaggacacggccatatattactgtgcgaaagatctggggaatgactacgatggtaccaacgtccgcttggactcctggggccagggagccctggtcaccgtctcctcagcctccaccaagggcccatcggtcttccccctggccgccctgcctccaggacgcacctccgagagcacagcggccctgggctgcctggtcaaggactactccgagtagtaca

SEQ ID NO: 458309 - DNA, 502 bp, Homo sapiens; identical to SEQ ID NO: 453671
  misc_feature: HEFZJCU01EXCTX.26.23.C01.1.454.heavy.3.raw

SEQ ID NO: 458310 - DNA, 497 bp, Homo sapiens; identical to SEQ ID NO: 445179
  misc_feature: HEFZJCU01CUYC6.12.55.E11.1.454.heavy.3.raw

SEQ ID NO: 458311 - DNA, 520 bp, Homo sapiens
  misc_feature: HEFZJCU01BKZQF.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtgggttcggggacctcaccctggttctacttcgatctctc

SEQ ID NO: 458312 - DNA, 396 bp, Homo sapiens
  misc_feature: HEFZJCU01DQ2FZ.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctcctccaagagcacctctgggggcacagcggccctgggctgcctggtcaaggactacttcctacgtgagct

SEQ ID NO: 458313 - DNA, 506 bp, Homo sapiens; identical to SEQ ID NO: 449588
  misc_feature: HEFZJCU01CQKB3.11.72.G06.1.454.heavy.3.raw

SEQ ID NO: 458314 - DNA, 476 bp, Homo sapiens
  misc_feature: HEFZJCU01CAEEZ.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaaggactacttccgagtgtaca

SEQ ID NO: 458315 - DNA, 525 bp, Homo sapiens
  misc_feature: HEFZJCU01A92I4.12.40.D07.1.454.heavy.3.raw
atacgacgtacacgaccggtgctcgatttagtgatagagcgtaacaacagagggctcaccatggagtttgggctgagcggtggtttcgtcgtaggcgtctttaagtaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtctttccccctggcg

SEQ ID NO: 458316 - DNA, 496 bp, Homo sapiens
  misc_feature: HEFZJCU01DKASH.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgacccctggggccagggaaccctggtcgtcgtctcgtctgcctccaccaggccatcggtcttcccctggcgccctgctccaggagcacctccgagagcacagcggccctgggctgcctggtcaggactacttccgtactagacg

SEQ ID NO: 458317 - DNA, 490 bp, Homo sapiens
  misc_feature: HEFZJCU01D4UAM.3.26.C04.1.454.heavy.3.raw
agacgcactccacgaccggtgctcgatttagtctagcgactttgggtttggggggtaaggaggaagacttgacggtccagcctgggaggtccctgagactctcctgtgcagcctctggattcagcttcagtgactatgctatgcactgggtccgccaggctccaggcaaggggctggagtgggtggcacttatatcatatgatggaagtaaacgtactacacagattccgtgcagggccgattcacaatctccagagacaactccaagaacacggtctatctgcaaatgagcagcctgcgagctgaggacaccgctctttattactgtgcgagagtctggggtgctacgagtactggtacttcgatctctggggccgtggcaccctgctgactgtctcctcagcctccaccaagggcccatcggtcttcccctggccgcctgctccaggagcacctccgagagcacagcggcctgggctgcctggtcaag

SEQ ID NO: 458318 - DNA, 378 bp, Homo sapiens; identical to SEQ ID NO: 444419
  misc_feature: HEFZJCU01C1YM9.47.77.G11.1.454.heavy.3.raw

SEQ ID NO: 458319 - DNA, 482 bp, Homo sapiens
  misc_feature: HEFZJCU01CM6T1.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagacctccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgagagcacagcggccctgggctgcctggtcaaggactacttcccagacgtatca

SEQ ID NO: 458320 - DNA, 517 bp, Homo sapiens
  misc_feature: HEFZJCU01EZBFK.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgttcatctgagggcagtgttcaatggtatgcagactccgtgaagggccgattcaccatctccagagacaattccaggaacacaatgtattggaaatgaacagcctaagtcctgaggacacgggtgtatactactgtacgaaggaggggggaaccaggcgggagttccaagtacttccg

SEQ ID NO: 458321 - DNA, 505 bp, Homo sapiens
  misc_feature: HEFZJCU01CR17F.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctgggctgcctggtcaaggactactcccactacta

SEQ ID NO: 458322 - DNA, 379 bp, Homo sapiens; identical to SEQ ID NO: 444450
  misc_feature: HEFZJCU01DA510.47.77.G11.1.454.heavy.3.raw

SEQ ID NO: 458323 - DNA, 518 bp, Homo sapiens; identical to SEQ ID NO: 449255
  misc_feature: HEFZJCU01DVJON.3.17.B06.1.454.heavy.3.raw

SEQ ID NO: 458324 - DNA, 515 bp, Homo sapiens
  misc_feature: HEFZJCU01CUVMA.49.41.D08.1.454.heavy.3.raw
agtcgagagacacgaccggtgctcgatttagtcacgcgagaaagggaaaggggactccaaggcctttccacttggtgatcagcactgagcacagaggactcaccatggagttggggctgagctgggttttccttgttgctattttagaaggtgtccagtgtgaggtgcagctggtggactcggggggaggcttggtccagcctgggggttccctgagactctcctgtgtagtctctggattcagctttaggagttattacatgagttgggtccgccaggctccagggaaggggctggagtgggtggccaacataaaccaagatggaactgtggaagactacatagactctgtgaagggccgattcaccatctccagagacaacgccaagaattcactgtttctgcacatgagcagtctgagagtcgaggacacggccttctattattgtgtgagtcagagtggcccaacccattggagccagggaaccctagtcagcgtctcctcagcctccacc

SEQ ID NO: 458325 - DNA, 525 bp, Homo sapiens; identical to SEQ ID NO: 450208
  misc_feature: HEFZJCU01DBR2X.3.82.H05.1.454.heavy.3.raw

SEQ ID NO: 458326 - DNA, 403 bp, Homo sapiens; identical to SEQ ID NO: 444540
  misc_feature: HEFZJCU01EKAVN.16.72.G06.1.454.heavy.3.raw

SEQ ID NO: 458327 - DNA, 491 bp, Homo sapiens
  misc_feature: HEFZJCU01CWLO2.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttcat

SEQ ID NO: 458328 - DNA, 383 bp, Homo sapiens; identical to SEQ ID NO: 444673
  misc_feature: HEFZJCU01ECE6H.11.61.F06.1.454.heavy.3.raw

SEQ ID NO: 458329 - DNA, 510 bp, Homo sapiens
  misc_feature: HEFZJCU01BNWI2.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcaggcggcctttgacttctggggccaggggacg

SEQ ID NO: 458330 - DNA, 488 bp, Homo sapiens
  misc_feature: HEFZJCU01CNJGS.3.75.G09.1.454.heavy.3.raw
  modified_base (478)..(478): a, c, t, g, unknown or other
agacgcactccacgaccggtgctcgatttagtatagacatcagggggacactgagtgtgagtgaacatgagtgagcaaaactggatttgtgtgccattttctgataacggtgtccttctgtttgcaggtgtccagtgtcaggtgcagctggtgcagtcgggggaggcgtggtccagcctgggaggtccctgagactctcctgtgcagcctctggcttcatcttcagtagctataaaatgcactgggtccgccaggctccaggcaaggggctggagtgggtggcacttatttcatatgatggaaggaacagatacttcgcagactccgtgaagggccgagtcaccatctccagagacaattccaagaacacggtgtctctgcaagtgaatagcctgagacgtgacgacacggctggtgtattactgtgcgagagagggtttcgcagctcgtccgggcggcccagttgaacatgacttancactacgtac

SEQ ID NO: 458331 - DNA, 524 bp, Homo sapiens; identical to SEQ ID NO: 457505
  misc_feature: HEFZJCU01BKGVX.9.37.D04.1.454.heavy.3.raw

SEQ ID NO: 458332 - DNA, 517 bp, Homo sapiens
  misc_feature: HEFZJCU01BZH5Z.13.76.G10.1.454.heavy.3.raw
tcacgtactacacgaccggtgctcgatttagtcactcatacagggggcccagcactgggattccgaggtgtttccattcggtgatcagcactgaacacagaggactcaccatggagttttggctgagcgtggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaatgaacagcctgagagccgatgacacggccgtgtattactgtgcgagagatggggcccacgaacgttactacgctatggacgtctgggccaagggaccacggtcaccg

SEQ ID NO: 458333 - DNA, 492 bp, Homo sapiens
  misc_feature: HEFZJCU01EFBKH.22.86.H09.1.454.heavy.3.raw
  modified_base (490)..(490): a, c, t, g, unknown or other
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctgggccagggacactggtcaccgtctcttcagcctccaccaagggcccatcggtcttcccctggcncc

SEQ ID NO: 458334 - DNA, 503 bp, Homo sapiens; identical to SEQ ID NO: 445995
  misc_feature: HEFZJCU01AYNH9.17.25.C03.1.454.heavy.3.raw

SEQ ID NO: 458335 - DNA, 520 bp, Homo sapiens; identical to SEQ ID NO: 452219
  misc_feature: HEFZJCU01BPXF2.10.79.H02.1.454.heavy.3.raw

SEQ ID NO: 458336 - DNA, 531 bp, Homo sapiens
  misc_feature: HEFZJCU01A5D7O.49.45.E01.1.454.heavy.3.raw
agtcgagagacacgaccggtgctcgatttagtgagtcagtaagggaaaggggtctgggagaggagccccagccgtgagattcccaggagattccacttggtgatcagcactgaacacagacctccaaccatggagtttgggcttagctgcgttttccttgttgctattttaaaaggtgtccattgtgaggtgcagctggttgagtctgggggaggcttggtacagcccgggcggtccctgagactctcctgtgtaacctcaggattcatctttggtgattatggaatgacctgggtccgccaggctccagggaagggcctggagtgggtagctttcgttagcagaaagactgaaggtgggacaacagaatacggcgcgtctgtgaaaggcagatttatcatctcaagagacgattaccaaaggcatcgcctatctgcaaatgaacagcctagaaaaccgaggacacagccgtgtattttgtactagagtcttcttgtattaccatgatactagttggttttacaggtaggc

SEQ ID NO: 458337 - DNA, 487 bp, Homo sapiens
  misc_feature: HEFZJCU01BULH9.14.55.E11.1.454.heavy.3.raw
cgtctagtaccacgaccggtgctcgatttagcactcgcacgttgggctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcggt

SEQ ID NO: 458338 - DNA, 518 bp, Homo sapiens; identical to SEQ ID NO: 450369
  misc_feature: HEFZJCU01BDJ49.7.78.H01.1.454.heavy.3.raw

SEQ ID NO: 458339 - DNA, 482 bp, Homo sapiens; identical to SEQ ID NO: 444904
  misc_feature: HEFZJCU01D1H9F.47.59.F04.1.454.heavy.3.raw

SEQ ID NO: 458340 - DNA, 486 bp, Homo sapiens; identical to SEQ ID NO: 446117
  misc_feature: HEFZJCU01B9VR4.51.14.B03.1.454.heavy.3.raw

SEQ ID NO: 458341 - DNA, 488 bp, Homo sapiens; identical to SEQ ID NO: 447044
  misc_feature: HEFZJCU01EK2EV.18.70.G04.1.454.heavy.3.raw

SEQ ID NO: 458342 - DNA, 500 bp, Homo sapiens
  misc_feature: HEFZJCU01C3MAM.53.78.H01.1.454.heavy.3.raw
cgcgtatacacacgaccggtgctcgatttagtgtgagtagtttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgaccctggggccagggaacctggtcaccgtctcctcagcttccaccaaggccatcggtcttcccctggcg

SEQ ID NO: 458343 - DNA, 513 bp, Homo sapiens
  misc_feature: HEFZJCU01C8KE9.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggacaatggtcaccgtctcttcagcctccaccaagggccatcggtcttcccctggcaccctcctccaagagcacctctggggcacagcggcccg

SEQ ID NO: 458344 - DNA, 535 bp, Homo sapiens
  misc_feature: HEFZJCU01D8DUQ.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatgggtttggggggagtttggggtttttttttcgttacttacgggt

SEQ ID NO: 458345 - DNA, 505 bp, Homo sapiens; identical to SEQ ID NO: 449275
  misc_feature: HEFZJCU01BAMZX.13.39.D06.1.454.heavy.3.raw

SEQ ID NO: 458346 - DNA, 520 bp, Homo sapiens
  misc_feature: HEFZJCU01EFJJW.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctcgtc

SEQ ID NO: 458347 - DNA, 496 bp, Homo sapiens
  misc_feature: HEFZJCU01ETYN1.47.85.H08.1.454.heavy.3.raw
  modified_base (484)..(484): a, c, t, g, unknown or other
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagcgtggttttccgtcgttaggctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagngttgacgagtct

SEQ ID NO: 458348 - DNA, 520 bp, Homo sapiens
  misc_feature: HEFZJCU01BPB44.17.33.C11.1.454.heavy.3.raw
cgtagactagcacgaccggtgctcgatttagagtgagctcgttgggtttgggctcaactctcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcgggagttattagtccctactttgactactgggccagggaactctggtcaccgtctccgcagcctccaccaagggcccatcggtcttcccctggcaccctcctccaagagcacctctgggggcacagcggccctgggctgcctggt

SEQ ID NO: 458349 - DNA, 523 bp, Homo sapiens
  misc_feature: HEFZJCU01EZW2R.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagccctccaccaagggcccatcggtcttcccctggcg

SEQ ID NO: 458350 - DNA, 390 bp, Homo sapiens
  misc_feature: HEFZJCU01CU4G7.16.17.B06.1.454.heavy.3.raw
tgtactactccacgaccggtgctcgatttagtcgatagtgaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 458351 - DNA, 537 bp, Homo sapiens
  misc_feature: HEFZJCU01C4IET.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgaccctggggcccgggaaccctggtcaccgtctcctcagcctccaccaacgggcccatccggtcttcccccgtc

SEQ ID NO: 458352 - DNA, 492 bp, Homo sapiens
  misc_feature: HEFZJCU01EEMFG.52.35.D02.1.454.heavy.3.raw
cgcagtacgacacgaccggtgctcgatttagcacacgatagttgggtttgggggaggcttggtccagcctggtggttccctgagactctcctgtgcagcctctggatttccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccagggggcggagcagccccgtaacttctggggccagggaacccgggtcaccgtctcctcagcctccaccaagggcccatcggtcttcccctggcaccctcctccaagagcacctctgggggcacagcggccctgggctgcctggtcaaggactacttcctatacgatcg

SEQ ID NO: 458353 - DNA, 517 bp, Homo sapiens
  misc_feature: HEFZJCU01CKGJM.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacgagcggccctggctgcctggtcaggactactcctagacgtatca

SEQ ID NO: 458354 - DNA, 518 bp, Homo sapiens
  misc_feature: HEFZJCU01BRMQD.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattccccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttcccctggcaccctcctccaagagcacctctgggggcacagcggccctgggctgcctggtcaaggactacttccagacgtatca

SEQ ID NO: 458355 - DNA, 526 bp, Homo sapiens
  misc_feature: HEFZJCU01EDQK0.52.22.B11.1.454.heavy.3.raw
cgcagtacgacacgaccggtgctcgatttagacgacagctcagggggggagaggagccccagccgtgagattcccaggagattccacttggtgatcagcactgaacacagacctccaaccatggagtttgggcttagctgcgttttccttgttgctattttaaaaggtgtccaatgtgaggtgcagctggttgagtctgggggaggcttggtacagccagggcggtccctgagactctcctgtgtaacctcaggattcatgtttggtgattatggaatgacctgggtccgccaggctccaggggagggcctggagtgggtagctttcgttagcagaaagactgaaggtgggacaacagaatacgccgcgtctgtgaaaggcagatttatcatctcaagagacgattccaaaggcatcgcctatctgcaaatgaacagcctgaaaaccgaggacacagccgtgtatttttgtactagagtcttcttgtattactatgatactagtggttttacaggtagcggggacg

SEQ ID NO: 458356 - DNA, 539 bp, Homo sapiens
  misc_feature: HEFZJCU01CF53F.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacactcccctgaaacgcgtacaactactactactacggtatggacctcgtggggaccg

SEQ ID NO: 458357 - DNA, 456 bp, Homo sapiens
  misc_feature: HEFZJCU01DVS67.48.71.G05.1.454.heavy.3.raw
agtatacatacacgaccggtgctcgatttagtgtcgtcgcaagagagaggggcaagggcgccagatggtccttcctcgtgagtcccaggaccaccctcggcctctggggtccagagtccaacaacccccgggccctccccggcctcaacctgagagagattcccagggacgttttccctggggtcctgacattgttgtcacaatgtgacaactgagtcgacccctggggccagagaaccctggtcaccgtctcctcagggtgaggatggacattccgccactgtgatcacttccactactgcggtatggacgtctggggccaagggaccacggtcaccgtctcctcagcttccaccaagggcccatcggtcttccccctggcgccctgctccaggagcacctctgggggcacagcggcctgggctgcctggtcaaggactacttcctatgtatact

SEQ ID NO: 458358 - DNA, 500 bp, Homo sapiens; identical to SEQ ID NO: 445028
  misc_feature: HEFZJCU01DIGZW.13.12.B01.1.454.heavy.3.raw

SEQ ID NO: 458359 - DNA, 519 bp, Homo sapiens
  misc_feature: HEFZJCU01BSWG3.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggccaccctcctccaagagcacctctgggggcacgagcggccctgggctgcctggtcaaggactattccagacgtatca

SEQ ID NO: 458360 - DNA, 506 bp, Homo sapiens; identical to SEQ ID NO: 446520
  misc_feature: HEFZJCU01CIWZS.10.38.D05.1.454.heavy.3.raw

SEQ ID NO: 458361 - DNA, 496 bp, Homo sapiens
  misc_feature: HEFZJCU01BIMH6.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggtacttcgt

SEQ ID NO: 458362 - DNA, 487 bp, Homo sapiens
  misc_feature: HEFZJCU01BSAPW.51.27.C05.1.454.heavy.3.raw
cgatcgtatacacgaccggtgctcgatttagacgcgatcgaagggtttggggctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtacaccctctggattcaccttcagtaactatgcaatgcactgggtccgccaggctccaggcaaggggctggactgggtggcagggtatatcatatgatggaagcaataaagtactacgcagactccgtgaagggccgattcaccatctccagagacagttccgatgacacagtctatctgcaaatgaacagcctgagagctgaggacacggcttctttttactgtgtcgccaggaagc

SEQ ID NO: 458363 - DNA, 516 bp, Homo sapiens
  misc_feature: HEFZJCU01D8X4M.52.27.C05.1.454.heavy.3.raw
cgcagtacgacacgaccggtgctcgatttagacgcgatcgaagggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaagggcttgagtggatggggtggaacaatcccaacagtggaggcaccggtcgcacagaatatgcgcggaagtttcagggcagggtcaccgatgaccagcgacaggtccactaacacagcctacatggagctaagtagactgacatctgacgacacggccgtctattattgtgtgagagaggacccgatgacctcgaacataggacgtcgtggggccac

SEQ ID NO: 458364 - DNA, 509 bp, Homo sapiens
  misc_feature: HEFZJCU01C6VDO.13.37.D04.1.454.heavy.3.raw
  modified_base (448)..(448): a, c, t, g, unknown or other
  modified_base (482)..(482): a, c, t, g, unknown or other
  modified_base (500)..(500): a, c, t, g, unknown or other
tcacgtactacacgaccggtgctcgatttagtagcatactgttgggtttggggtctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagtttagcagttatgccatgagctgggtccgccaggctccagggaaggggctggagtgggtttcgggtattagtgctcttgatgatagcacatactatgcagactccgttaagggccgcttcaccatcctccagagacaattccaagaacacgctatatctgcagatgaacagcctggganccgaggacacggccgtttatcactgtgcgaaagntattgtaatgaatggtanctgctacta

SEQ ID NO: 458365 - DNA, 506 bp, Homo sapiens; identical to SEQ ID NO: 444696
  misc_feature: HEFZJCU01CGEQV.16.34.D01.1.454.heavy.3.raw

SEQ ID NO: 458366 - DNA, 527 bp, Homo sapiens
  misc_feature: HEFZJCU01DTIDK.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgactccggtgacgcctaccggcgacggccggtccttttggactttcgttgggggcccagggggaccg

SEQ ID NO: 458367 - DNA, 511 bp, Homo sapiens; identical to SEQ ID NO: 447235
  misc_feature: HEFZJCU01DVGIL.16.21.B10.1.454.heavy.3.raw

SEQ ID NO: 458368 - DNA, 378 bp, Homo sapiens
  misc_feature: HEFZJCU01CKGR3.47.30.C08.1.454.heavy.3.raw
agctcacgtacacgaccggtgctcgatttagtctgacgtcaaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttgggccggggaaccctggtcaccgtctcttcagcttccaccaagggcccatcggtcttccccctggcgccctgctccaggagcacctctgggggcacagcggccctgggctgcctggtcaaggactacttcctacgtgagct

SEQ ID NO: 458369 - DNA, 396 bp, Homo sapiens; identical to SEQ ID NO: 450722
  misc_feature: HEFZJCU01DRUU8.16.68.G02.1.454.heavy.3.raw

SEQ ID NO: 458370 - DNA, 493 bp, Homo sapiens
  misc_feature: HEFZJCU01CL57H.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtgcagatatacaatatgatgacagtaaatatactatggagactccttcaagggccgattcaccatctccagagacaattccaagaacatggtgtatctgcaaatgaccagcctgagagccgaggacacgggtgtttattactgtgggagaaatcctagtggc

SEQ ID NO: 458371 - DNA, 497 bp, Homo sapiens
  misc_feature: HEFZJCU01CU563.7.85.H08.1.454.heavy.3.raw
cgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactggtccgccaggctccagggaagggctgcagtgggtttcacacattaatactggaagtaggaccataacttacacagactctgtgaagggccgattcaccacctccagagacgacgccaagaactcactgtctctgcaatgaacagcctgagagtcgaggacacggctgtgtattactgtgcgagagatccggaggggacgtatgacc

SEQ ID NO: 458372 - DNA, 512 bp, Homo sapiens
  misc_feature: HEFZJCU01BE33F.47.55.E11.1.454.heavy.3.raw
agctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggtaacccg

SEQ ID NO: 458373 - DNA, 403 bp, Homo sapiens
  misc_feature: HEFZJCU01AJYNF.47.24.C02.1.454.heavy.3.raw
agctcacgtacacgaccggtgctcgatttagtacagatcgttagggaaagggactggaggtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattacgtaccactcctacttggacgtctggggcaaagggaccgcggtcaccgtctcctcagcctccaccaagggcccatcggtcttccccctggcgccctgctccaggagcacctcccgagagcacagcggccctgggctgcctggtcaaggactacttcctacgtgagct

SEQ ID NO: 458374 - DNA, 521 bp, Homo sapiens
  misc_feature: HEFZJCU01EM9MX.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctgccg

SEQ ID NO: 458375 - DNA, 556 bp, Homo sapiens
  misc_feature: HEFZJCU01EL70S.12.40.D07.1.454.heavy.3.raw
atacgacgtacacgaccggtgctcgatttagtgatagagcgtaacaacagagggctcaccatggagtttgggctgagcgtgggttttcctcgttgctcttttaagtaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctacaaatagacagcctgagaccagaacgacacggctgtctattattgtgcgagagagacacacgaaccctactggccaatactagtgggggcttgtttctgggggccgagggggaccccgtgggtcattccgtcctccccacgccctcccacccaaggggccccagtccgggttccttccccccgttggccgcccc

SEQ ID NO: 458376 - DNA, 524 bp, Homo sapiens
  misc_feature: HEFZJCU01DDPZC.13.65.F10.1.454.heavy.3.raw
tcacgtactacacgaccggtgctcgatttagctacgctctaaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggtttttggggcgcggactcctcttgagatctggggccaggggacaagtggtcaccgtctctttcagt

SEQ ID NO: 458377 - DNA, 533 bp, Homo sapiens
  misc_feature: HEFZJCU01DELS4.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaagtaatggctgtgtttatggggccagggagcctggtctaccg

SEQ ID NO: 458378 - DNA, 522 bp, Homo sapiens
  misc_feature: HEFZJCU01CE2DS.10.53.E09.1.454.heavy.3.raw
catagtagtgcacgaccggtgctcgatttagagagagtgtgttgggtttgggggctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccggttcggggccgattcaccatctccaaagacaatttgaagaacacgctgtttctgcaatagaacagcctgagagctgaggacacggctgtatattacttgttcgtttggttctgtactcggtcgggggaataccttcagctacgg

SEQ ID NO: 458379 - DNA, 522 bp, Homo sapiens
  misc_feature: HEFZJCU01B9731.19.6.A06.1.454.heavy.3.raw
tactctcgtgcacgaccggtgctcgatttagatctactgacagggggagagaggagcccagccctgggattttcaggtgttttcatttggtgatcaggactgaacagagagaactcaccatggagtttgggctgagctggctttttcttgtggctattttaaaaggtgtccagtgtgaagtgcaactggtggagtctgggggaggcttggtacagcctggggggtccctgagactctcctgtgcagcctctggattcacctttagcaactatgccatgacctgggtccgccaggctccagggaaggggctggagtgggtctcagttattagtgggagtggtgggggaacatactacgcagactccgtgaagggccggttcaccatttccagagacaattccaagaacaccctgtatctgcacatgaacagcctgagagccgaggacacggccgtatatttctgtgcgaaagatctcggtatggcactagctggcaagcccgaacctttgactattgggccac

SEQ ID NO: 458380 - DNA, 511 bp, Homo sapiens; identical to SEQ ID NO: 456075
  misc_feature: HEFZJCU01CAQ2E.17.33.C11.1.454.heavy.3.raw

SEQ ID NO: 458381 - DNA, 518 bp, Homo sapiens; identical to SEQ ID NO: 446192
  misc_feature: HEFZJCU01B7R2K.7.78.H01.1.454.heavy.3.raw

SEQ ID NO: 458382 - DNA, 511 bp, Homo sapiens
  misc_feature: HEFZJCU01EI6PN.14.71.G05.1.454.heavy.3.raw
cgtctagtaccacgaccggtgctcgatttagtgtcgtcgcaagagagaggggcccagccctgggattttcaggtgttttcattcggtgatcaggactgaacagagagaactcaccatggagtttggggctgagcgtggcgttttcttaggtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaagggctggagtgggtctctgctattcctggcagtggtgatatcgaatactacgcagactccgtgaagggccggttcactgttccagagacaattccaagaacacactgtatctgcagatgaccagccctgagaggccgaggacacggccgtatattactgtgcgaaacgccaagatttttggagtggttattatacctttgactcttc

SEQ ID NO: 458383 - DNA, 396 bp, Homo sapiens; identical to SEQ ID NO: 444469
  misc_feature: HEFZJCU01BPHMM.47.46.E02.1.454.heavy.3.raw

SEQ ID NO: 458384 - DNA, 507 bp, Homo sapiens; identical to SEQ ID NO: 445401
  misc_feature: HEFZJCU01COPR2.22.86.H09.1.454.heavy.3.raw

SEQ ID NO: 458385 - DNA, 516 bp, Homo sapiens
  misc_feature: HEFZJCU01CEPR7.21.70.G04.1.454.heavy.3.raw
tcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggaccgcagtcaccgtctcctcagcctccaccaagggcccatcggtcttcccctggcgccctgctccaggagcacctccgagaggcacg

SEQ ID NO: 458386 - DNA, 517 bp, Homo sapiens
  misc_feature: HEFZJCU01CAP3U.48.19.B08.1.454.heavy.3.raw
agtatacatacacgaccggtgctcgatttagtgagtcagtaagggggatctcatgtgcaagaaaatgaagcacctgtggttcttcctcctcctggtggcggctcccagatgggtcctgtcccagctgcagctgcaggaggtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcgagggggccgggattattgttatagaaccacctgctatctgagctggttcgactgcgtggggccagggaaccctggtcaccgtctcctcacgcctccacaac

SEQ ID NO: 458387 - DNA, 483 bp, Homo sapiens
  misc_feature: HEFZJCU01DYCUD.48.35.D02.1.454.heavy.3.raw
agtatacatacacgaccggtgctcgatttagcacacgatagttgggtttggggatcacagaacaaccacactcctcctctaaagaagcccctgggagcacggcgcatcaccatggactggacctggaggttcctctttgtggtggcagcagctacatgtgtccagtcccaggtgcagctggtgcagtctggggctgaagtgaagaagcctgggtcctcggtgagggtctcctgcaagacttctagagacaccttcaacagctatgctatcagctgggtgcgacaggcccctggacaaggtcttgagtggatgggagtaatcgtcccttcttcaactagaacgcactacgcacagaagttcgaggacagagtcacatttatggtggataaagccacgagcacagtctacatgcagctgagcagcctgagacacaacgacacggccgtctattattgttccagagataatcgcgtgaataaagat

SEQ ID NO: 458388 - DNA, 507 bp, Homo sapiens
  misc_feature: HEFZJCU01A0G4I.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgacaatgaacagcctgagaaccgacgacacggccgtctattattgtgtcatagacctaggatacaacgac

SEQ ID NO: 458389 - DNA, 509 bp, Homo sapiens; identical to SEQ ID NO: 445824
  misc_feature: HEFZJCU01AWY9Q.9.14.B03.1.454.heavy.3.raw

SEQ ID NO: 458390 - DNA, 476 bp, Homo sapiens
  misc_feature: HEFZJCU01A46WG.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgactcctggggccagggaaccctggtcaccgtctcctcagcctccaccaagggcccatcggtcttcccctggcgccctgctccaggagcacctccgagagcacagcggccctgggctgcctggtcaaggactacttccgagtagtaca

SEQ ID NO: 458391 - DNA, 517 bp, Homo sapiens
  misc_feature: HEFZJCU01C9QZX.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttcccctggcaccctcctccaagagcacctctgggggcacagcggccctgggctgcctggtcaaggactacttccgacgtatca

SEQ ID NO: 458392 - DNA, 490 bp, Homo sapiens
  misc_feature: HEFZJCU01D2PV4.19.1.A01.1.454.heavy.3.raw
tactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaagggcttgagtggatggaggaagcatccctttctttgatactccagactacgcacagaagttccagggcagagtcacgattaccgcggacgaatccacgagcacagtctataatggaattgaccagcctgacatcagaggacacggccgtctattttgtgcgacagaaagagatccatactcaggcgggcactatggcagc

SEQ ID NO: 458393 - DNA, 509 bp, Homo sapiens
  misc_feature: HEFZJCU01CIUMS.3.81.H04.1.454.heavy.3.raw
agacgcactccacgaccggtgctcgatttagtagtgtagattcgcgggctggtggagtctgggggaggcttggtccagcctggggggtccctgagactctcctgtgcagcctctggattcagctttagtaccaattggatgaactgggtccgccaggctccagggaaggggctggagtggctggcccacataaacccagatggaacttattcacactatgtggactctgtgaggggccgattcaccatctccagagacaaccccaagaactcactgtttctgcaaatggacagcctgagagccgaggacacggctgtatattactgtgcgagagatatgagaaactcaaatgatagaaatcagggatgggggccagggaaccctggtcaccgtctcctcagcctccaccaagggcccatcggtcttcccctggcgccctgctccaggagcacctccgagagcacagcggccctgggctgcctggtcaaggactacttccgagtgcgtct

SEQ ID NO: 458394 - DNA, 506 bp, Homo sapiens; identical to SEQ ID NO: 449588
  misc_feature: HEFZJCU01B0QNH.11.72.G06.1.454.heavy.3.raw

SEQ ID NO: 458395 - DNA, 528 bp, Homo sapiens
  misc_feature: HEFZJCU01CYMTC.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttaggactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagctgagaaccgaggacacagccgtgtattactgtaccacactccctagaagcgtacaactactactactacggtatcggactc

SEQ ID NO: 458396 - DNA, 504 bp, Homo sapiens
  misc_feature: HEFZJCU01DZG96.4.81.H04.1.454.heavy.3.raw
agcactgtagcacgaccggtgctcgatttagtagtgtagattcgcggggtctgagagaggagccttagccctggattccaaggcctatccacttggtgatcagcactgagcaccgaggattcaccatggaactggggctccgctgggttttccttgttgctattttagaaggtgtccagtgtgaggtgcacctggtggagtctgggggaggcctggtcaaacctggggggtccctgagactctcgtgtgtagtctctgaattcatcttcagggactttgacatgaattgggtccgccaggctccagggaaggggctggagtgggtctcatccatcagttccagtactcgttacatatactacgcagactcagtgaggggccgattcaccatctccagagacaacgccaagaactcagtgtttctgcaaatgaacagcctgagagtcgaggactcggctgtctactactgtgcgagaataagggagctacctacgatttggacac

SEQ ID NO: 458397 - DNA, 539 bp, Homo sapiens
  misc_feature: HEFZJCU01EPT9A.19.48.E04.1.454.heavy.3.raw
tactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgccaggctccggggaaggggccggagtgggtggccaacataatgcaagatggaactgagaaaaactatggggactctgtgaagggccgattcaccatctccagagacaaccgtaagaacttactgtttctgcaaaatgaacagcctgagagccgaggacacggctgtgtattattgtgcgaagggcagtggctgggacagtggacgtctgggggccaaggggaccacgggtccaccggtt

SEQ ID NO: 458398 - DNA, 412 bp, Homo sapiens
  misc_feature: HEFZJCU01CLB8P.51.60.F05.1.454.heavy.3.raw
cgatcgtatacacgaccggtgctcgatttagtacgtcatcagggaaagggactggagtggattggatatatctattacaatgggaggaccgactacaacccctccctcaagagtcgagtcaccatatcagttgactcgtccaagaagcagttctccctgaagctgaactctgtgaccgctgcggacacggccgtgtatttctgtgcgaaagttcaggccccatattattatgacagtagtggttatcaaataggggcctactttgaccactggggccggggaaccctggtcaccgtctcctcagcctccaccaagggcccatcggtcttccccctggcaccctcctccaagagcacctctgggggcacagcggccctgggctgcctggtcaaggactacttcctcgtagcct

SEQ ID NO: 458399 - DNA, 507 bp, Homo sapiens
  misc_feature: HEFZJCU01EI2BP.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcgagggggccgggatattgttatagaaccacctgctatctgagctggttcgactgctggggccagggaaccctggtc

SEQ ID NO: 458400 - DNA, 496 bp, Homo sapiens; identical to SEQ ID NO: 444697
  misc_feature: HEFZJCU01ELFHB.16.37.D04.1.454.heavy.3.raw

SEQ ID NO: 458401 - DNA, 479 bp, Homo sapiens; identical to SEQ ID NO: 450171
  misc_feature: HEFZJCU01CXOXC.14.70.G04.1.454.heavy.3.raw

SEQ ID NO: 458402 - DNA, 514 bp, Homo sapiens; identical to SEQ ID NO: 449003
  misc_feature: HEFZJCU01BRSES.4.57.F02.1.454.heavy.3.raw

SEQ ID NO: 458403 - DNA, 502 bp, Homo sapiens
  misc_feature: HEFZJCU01DE70I.49.35.D02.1.454.heavy.3.raw
agtcgagagacacgaccggtgctcgatttagcacacgatagttgggtttgggctgagctgggttttcctcgttgctcttttaagaggtgtccagtgtcatgtgcagttgatacagtctgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaaggcccatcggtcttcccctgcg

SEQ ID NO: 458404 - DNA, 517 bp, Homo sapiens
  misc_feature: HEFZJCU01CPRH3.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctgtggccaggggaccg

SEQ ID NO: 458405 - DNA, 508 bp, Homo sapiens
  misc_feature: HEFZJCU01D389O.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaagggcccatcggtcttcccctggccgccctgctccaggacg

SEQ ID NO: 458406 - DNA, 486 bp, Homo sapiens
  misc_feature: HEFZJCU01BEK9M.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattattgtgcccttgattactatga

SEQ ID NO: 458407 - DNA, 531 bp, Homo sapiens
  misc_feature: HEFZJCU01EPO0D.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctcaccaaggg

SEQ ID NO: 458408 - DNA, 509 bp, Homo sapiens; identical to SEQ ID NO: 444586
  misc_feature: HEFZJCU01D9NVL.12.78.H01.1.454.heavy.3.raw

SEQ ID NO: 458409 - DNA, 513 bp, Homo sapiens; identical to SEQ ID NO: 446699
  misc_feature: HEFZJCU01B6GXV.12.25.C03.1.454.heavy.3.raw

SEQ ID NO: 458410 - DNA, 507 bp, Homo sapiens; identical to SEQ ID NO: 448371
  misc_feature: HEFZJCU01EYVTU.3.81.H04.1.454.heavy.3.raw

SEQ ID NO: 458411 - DNA, 513 bp, Homo sapiens
  misc_feature: HEFZJCU01CYCXX.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcgttttcttagtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatacctactttgactactggggccg

SEQ ID NO: 458412 - DNA, 509 bp, Homo sapiens
  misc_feature: HEFZJCU01BHSEI.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaagggctggagtgggtaggtttcattagagccatggcttatgctgggacaacagaatacgccgcgtctgtgaaggcagattcatcatctcaagagatgattccaacggcatcgcctatctgcagatgaacagcctgaagaccgaggacacagccgtctattactgtgttagggtagttttacgtatttttggt

SEQ ID NO: 458413 - DNA, 495 bp, Homo sapiens
  misc_feature: HEFZJCU01BY2MQ.52.85.H08.1.454.heavy.3.raw
cgcagtacgacacgaccggtgctcgatttagtatcactcagtcgcggggtatcactcagtcgcggggatactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctgatgcctccatcagtcgtgacgattactactggagctggatccgccagcccccagggaagggcctggaatggattggctacatcttttacagtgagagcacctcctacaacccgtccctcaagagtcgagttaccatatcagctgacaagtccaagaaccacttctccctgaagctgacctctgtgactgccacagacacggccgtctattactgtgccagagggatcgctagaggtggctccatcgttttagactccg

SEQ ID NO: 458414 - DNA, 520 bp, Homo sapiens
  misc_feature: HEFZJCU01C5WEW.7.10.A10.1.454.heavy.3.raw
  modified_base (483)..(483): a, c, t, g, unknown or other
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtacgacgacttaccttacgagagacncgcgtagcgggcggcggtcggacggaacgggcgacat

SEQ ID NO: 458415 - DNA, 507 bp, Homo sapiens
  misc_feature: HEFZJCU01EJ7ZG.52.38.D05.1.454.heavy.3.raw
cgcagtacgacacgaccggtgctcgatttagtatctgatagttgggtttgggaccggtgctcgattcagtgtgaggcgcagctggtggagtctgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttcccctggcaccctcctccaagagca

SEQ ID NO: 458416 - DNA, 483 bp, Homo sapiens; identical to SEQ ID NO: 444924
  misc_feature: HEFZJCU01CERWB.10.35.D02.1.454.heavy.3.raw

SEQ ID NO: 458417 - DNA, 523 bp, Homo sapiens; identical to SEQ ID NO: 451418
  misc_feature: HEFZJCU01B6OOG.12.40.D07.1.454.heavy.3.raw

SEQ ID NO: 458418 - DNA, 395 bp, Homo sapiens
  misc_feature: HEFZJCU01BXO4F.47.46.E02.1.454.heavy.3.raw
agctcacgtacacgaccggtgctcgatttagactcatctacagggaaggggctggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgacgaaagtctatagcagtgccccctacgcgcacttctttgacttctgggccagggaatcctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 458419 - DNA, 538 bp, Homo sapiens
  misc_feature: HEFZJCU01AELIR.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggcttttcttgtggctttttaaaaggtgcccagtgtgaggtgcaactgttggagtctgggggaggcttggtacagccggggggtccctgagactctcctgtgcagcctctggattcaatttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgccctataatggtggctggatcggggagtttggttcctggggccaggggaaccctggtcc

SEQ ID NO: 458420 - DNA, 519 bp, Homo sapiens
  misc_feature: HEFZJCU01EORRQ.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatcggtcttcccctggcgccctgctccaggagcacctccgagagcacagcggccc

SEQ ID NO: 458421 - DNA, 494 bp, Homo sapiens
  misc_feature: HEFZJCU01DDUMX.51.38.D05.1.454.heavy.3.raw
  modified_base (469)..(469): a, c, t, g, unknown or other
cgatcgtatacacgaccggtgctcgatttagtatctgatagttgggtttggggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctctttttactgttntgccaggaagcagtggctggccaca

SEQ ID NO: 458422 - DNA, 550 bp, Homo sapiens
  misc_feature: HEFZJCU01CMA3Q.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcacgtctcctctaacggtccctaccaacccgtaacgggtaccccg

SEQ ID NO: 458423 - DNA, 496 bp, Homo sapiens; identical to SEQ ID NO: 444697
  misc_feature: HEFZJCU01ESG98.16.37.D04.1.454.heavy.3.raw

SEQ ID NO: 458424 - DNA, 395 bp, Homo sapiens; identical to SEQ ID NO: 445547
  misc_feature: HEFZJCU01BIEL4.18.31.C09.1.454.heavy.3.raw

SEQ ID NO: 458425 - DNA, 396 bp, Homo sapiens; identical to SEQ ID NO: 444568
  misc_feature: HEFZJCU01AQS41.47.46.E02.1.454.heavy.3.raw

SEQ ID NO: 458426 - DNA, 488 bp, Homo sapiens; identical to SEQ ID NO: 447708
  misc_feature: HEFZJCU01CIMHV.47.85.H08.1.454.heavy.3.raw

SEQ ID NO: 458427 - DNA, 536 bp, Homo sapiens
  misc_feature: HEFZJCU01CSEKE.52.73.G07.1.454.heavy.3.raw
cgcagtacgacacgaccggtgctcgatttagctctacgctcagggggtgctttccgagagtcatggacctcctgcacaagaacatgaaacacctgtggttcttcctcctcctggtggcagctcccagatgggtcctgtcccaggtgcacctacaacagtggggcgcaggactgttgaagccttcggagaccctgtccctcacctgcgctgtcgatggtgggtccttcagtggtcgctactggacctggatccgccagcccccagggaaggggctggagtggattggggaaatcaatcatactggaagcattaactataacccgtcccttaagagtcgagtcaccatatcagtcgacacgtccaagaaccaattctccctgaaggtgaggtctgttaccgccgcggacacggctgtctattactgtgcgaaaggccctcacgatgaaactacgccctcggcgctatggacgtctggggccgaagggaccacggtcaccgtctcctcagcctccaccaaggcccatcggtctcccctc

SEQ ID NO: 458428 - DNA, 507 bp, Homo sapiens; identical to SEQ ID NO: 449215
  misc_feature: HEFZJCU01DBOR7.16.34.D01.1.454.heavy.3.raw

SEQ ID NO: 458429 - DNA, 514 bp, Homo sapiens
  misc_feature: HEFZJCU01DQY7T.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaaggggattggagtgggtggcagttgtttcatctgagggcagtgttcaatggtatgctgacgccgtgaagggccgattcaccatctccagagacaactccaggaacacaatgtattggacctgaacagcctaagtcctgaggacacgggtgtatactactgtacgaaggagggggaaccagcgggagttccaagtactctttg

SEQ ID NO: 458430 - DNA, 529 bp, Homo sapiens
  misc_feature: HEFZJCU01AD3DU.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactcccgaccccgtgaagggccgattaaccatctccagagacgattccgagaacacggtgtatcttcaaatgaacaacctgagagccgacgacacggccgtttattactgtgcgagagattcgagtgggttcggggacctccacccttggttccttacttcgatctctgggggcc

SEQ ID NO: 458431 - DNA, 396 bp, Homo sapiens
  misc_feature: HEFZJCU01CO8AL.47.46.E02.1.454.heavy.3.raw
agctcacgtacacgaccggtgctcgatttagactcatctacagggaaaggggctggagtgggtctcaagtattgatgagaatggtggaagcacattctacgtggactccgtgaagggccggttcaccatctccagagacaattttcaggagcacgctgtatctacaaatgaacagcctgagagccgaggacacggccgtatatttctgtgcgaaagtctatagcagtgccccctacgcgcacttctttgacttctggggccagggaatcctggtcaccgtctccacagcctccaccaagggcccatcggtcttccccctggcgccctgctccaggagcacctccgagagcacagcggccctgggctgcctggtcaaggactacttctacgtgagct

SEQ ID NO: 458432 - DNA, 500 bp, Homo sapiens
  misc_feature: HEFZJCU01A2BFY.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacgacctgagacctgacgacacggcaatttattactgtgcgagggtttatgtgttggaacgtggtacaccggaaaactggttcgacccctggggccagggaaccctggtcgtcgtctcgtctgcctccaccaagggcccatcggtcttcccctggcgccctgctccaggagcacctccgagagcacagcggccctgggctgcctggtcaaggactacttccgtactagacg

SEQ ID NO: 458433 - DNA, 499 bp, Homo sapiens
  misc_feature: HEFZJCU01CXQRU.14.55.E11.1.454.heavy.3.raw
cgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaatgaatagcctgagagccgaggacacggctgtgtattactgtgtcagagatgggagggggtggtgatcc

SEQ ID NO: 458434 - DNA, 379 bp, Homo sapiens; identical to SEQ ID NO: 444450
  misc_feature: HEFZJCU01B0XGV.47.77.G11.1.454.heavy.3.raw

SEQ ID NO: 458435 - DNA, 508 bp, Homo sapiens; identical to SEQ ID NO: 454747
  misc_feature: HEFZJCU01D7QYZ.12.30.C08.1.454.heavy.3.raw

SEQ ID NO: 458436 - DNA, 548 bp, Homo sapiens
  misc_feature: HEFZJCU01AJIVD.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcactttatttatagtggtggtaccacatactacacagactccgtgaagggccgattcaccatctcagaagacaattccaggaacacattgtatcttcaaatgaataacctgagagccgaggacacggccatgtattactgtgtggggctaatttacttcgaccccttgggggcccgggggtaacccgtgggtcacccggtcctcccccacccctcccaacccg

SEQ ID NO: 458437 - DNA, 546 bp, Homo sapiens
  misc_feature: HEFZJCU01CCAUY.15.86.H09.1.454.heavy.3.raw
tctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaagtaaaatgatggtgagaaaatagactacggtgcacccgtgaaaggaagattcaccatctcaagagataattcaaaaacgacggtgtatttgcaaatgaacagcctgaaaaccgaggacacagccgtctattactgtaccacagattcggaagtgcatcgacgtaaaggaggctatgcttttgatatctggggcccaggggacaagt

SEQ ID NO: 458438 - DNA, 519 bp, Homo sapiens
  misc_feature: HEFZJCU01B5QB1.49.78.H01.1.454.heavy.3.raw
agtcgagagacacgaccggtgctcgatttagtgtgagtagtttgggtttgggggggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacaccttattttcgacctactgcggccaac

SEQ ID NO: 458439 - DNA, 498 bp, Homo sapiens
  misc_feature: HEFZJCU01ANTQ7.40.53.E09.1.454.heavy.3.raw
tctagcgactcacgaccggtgctcgatttagagagagtgtgttgggtttggggacccaacaaccacatccctcctcagaagcccccagagcacaactccttaccatggactggacctggaggatcctctttttggtggcagcagccacaggtgcccactcccaggtccagcttgtgcagtctggggctgaggtgaagaagcctggggcctcagtgagggtttcctgcaaggcgtctggatattccttcactacctacactctgcattggctgcgccaggcccccggacacagctttgagtggatggggtggctcaacgctggcgatggaaaaacaaaatattcagagaagttccagggcagagtcaccattacaagggacacaatcgcgcgcaatgcttacatggagttgaggagcctgagatctgaagacacggctgtgtattactgtgtgagaggcggatattgtcgtggtggtgactgctacagtcaaaatcgtc

SEQ ID NO: 458440 - DNA, 521 bp, Homo sapiens
  misc_feature: HEFZJCU01CNVW8.48.26.C04.1.454.heavy.3.raw
  modified_base (410)..(410): a, c, t, g, unknown or other
agtatacatacacgaccggtgctcgatttagtctagcgactttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatgganctgaggagcctgagatctgacgacacggccgtgtattactgtgcgagagaaggggtttttacattgggttcggggagtctaccgacccaggccaacgtggttacgtacccc

SEQ ID NO: 458441 - DNA, 524 bp, Homo sapiens
  misc_feature: HEFZJCU01D1N3O.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacactcccctgaaagcgtcaactactactactacggtat

SEQ ID NO: 458442 - DNA, 537 bp, Homo sapiens
  misc_feature: HEFZJCU01AVN7X.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagacacgctgtatctgcaaatgaacagcctgagaaccgaggacacagccgtgtattactgtaccacatcccctgaaagcgtcaactactactactacggtatggacctctgggaccg

SEQ ID NO: 458443 - DNA, 503 bp, Homo sapiens
  misc_feature: HEFZJCU01EJ3WA.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctatactgtgcgagaatgttttctgtcatcgtactaatttagataggctctatggactggacttcgtc

SEQ ID NO: 458444 - DNA, 509 bp, Homo sapiens; identical to SEQ ID NO: 447939
  misc_feature: HEFZJCU01CXRFY.17.25.C03.1.454.heavy.3.raw

SEQ ID NO: 458445 - DNA, 493 bp, Homo sapiens
  misc_feature: HEFZJCU01BTCPB.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaaacagcctgagagctgaggacacggctgtgtattactgtgggagagatggaggtcgatattgt

SEQ ID NO: 458446 - DNA, 514 bp, Homo sapiens
  misc_feature: HEFZJCU01AZ4GX.48.65.F10.1.454.heavy.3.raw
agtatacatacacgaccggtgctcgatttagctacgctctaagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttctatggtgggtccttcagtggttactactggagctggatccgccagcccccagggaaggggctggagtggattggggaaatcaatcatagtggaagcaccaactacaacccgtccctcaggagtcgagtcaccatatcagtagacacgtccaagaaccagttctccctgaagctgagctctgtgaccgccgcggacacggctgtgtattactgtgcgagagcggatattgtagtagtaccagctgcttatttttgtccggtggttcgaccctggggccagggaaccctggtcaccgtctcctc

SEQ ID NO: 458447 - DNA, 507 bp, Homo sapiens
  misc_feature: HEFZJCU01A8F16.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctggcgccctgctccaggagcacctccgagagcacagcggccctgggctgcctggtcaaggactacttcccactaccta

SEQ ID NO: 458448 - DNA, 509 bp, Homo sapiens
  misc_feature: HEFZJCU01EY05G.10.85.H08.1.454.heavy.3.raw
catagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctggtcaccgtctcatcagcctccacc

SEQ ID NO: 458449 - DNA, 396 bp, Homo sapiens; identical to SEQ ID NO: 444469
  misc_feature: HEFZJCU01E2RC1.47.46.E02.1.454.heavy.3.raw

SEQ ID NO: 458450 - DNA, 372 bp, Homo sapiens; identical to SEQ ID NO: 447933
  misc_feature: HEFZJCU01D58U0.49.45.E01.1.454.heavy.3.raw

SEQ ID NO: 458451 - DNA, 399 bp, Homo sapiens
  misc_feature: HEFZJCU01C5MZQ.16.80.H03.1.454.heavy.3.raw
tgtactactccacgaccggtgctcgatttagctgtgcgtcgaagggaaagggactggaatatgtttcagctattagttataatgggggtaacacatactacgcagactcagtgaagggcagattcaccatctccagagacaattcccagaacacgctggatcttcaaatgagcagtctgagagctgaggacacggctgtgtattactgtgtgaaagattttccgtggctactacgactactactacggtatggacgtctggggccaagggaccacggtcaccgtctcctcagcctccaccaagggcccatcggtcttccccctggcaccctcctccaagagcacctctggggcacagcggccctgggctgcctggtcaggactacttccgagtagtaca

SEQ ID NO: 458452 - DNA, 518 bp, Homo sapiens
  misc_feature: HEFZJCU01D90CL.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttggttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaagggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgaccctggggccagggaaccctggtcaccgtctcctcag

SEQ ID NO: 458453 - DNA, 519 bp, Homo sapiens
  misc_feature: HEFZJCU01ECU7N.13.76.G10.1.454.heavy.3.raw
tcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggccaagggaccg

SEQ ID NO: 458454 - DNA, 503 bp, Homo sapiens
  misc_feature: HEFZJCU01E06BZ.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgcccagacacggctgtctattactgtgcgaggccccgagcgcagtggctttttgatgtcctttgatatgtggggccaagggacaatggtcaccgtctcttc

SEQ ID NO: 458455 - DNA, 551 bp, Homo sapiens
  misc_feature: HEFZJCU01CYWXB.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagcgtggcgttttcttagtggctttttaaaaggtgccagtgtgaggtgcaactgttggagtctgggggaggcttggtacagccgggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaacactgtatctgcaattaaccagcctgagagtcgaggacacggccctttattactgtgcgaaggatcgcccctataatggtggttggatcggggagtttggttccttgggggcccaggggaacccctggtctacccg

SEQ ID NO: 458456 - DNA, 398 bp, Homo sapiens; identical to SEQ ID NO: 444798
  misc_feature: HEFZJCU01AWFD6.4.60.F05.1.454.heavy.3.raw

SEQ ID NO: 458457 - DNA, 489 bp, Homo sapiens
  misc_feature: HEFZJCU01CVWW0.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcggggccaagggacaaatggtcaccgtctcttcagcctccaccaagggcccatcggtcttccccctggcaccctcctccaagagcacctctgggggcacagcggccctgggctgcctggtcaaggactacttccgagtgcgtct

SEQ ID NO: 458458 - DNA, 511 bp, Homo sapiens
  misc_feature: HEFZJCU01B4Q1U.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccgtgaactactggggccagggcaccctggtcaccgtctcctcagcttccaccaagggcccatcggtcttcccctggcgccctgctccaggagcacctctgggggcacagcggccctgggctgcctggtccaaggactacttcccata

SEQ ID NO: 458459 - DNA, 504 bp, Homo sapiens
  misc_feature: HEFZJCU01D5NGB.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaaggcccatcggtcttcccctggcgccctgctccaggagcacctccgagagcacagcggccctgggctgcctggtcaaggactacttcccactacta

SEQ ID NO: 458460 - DNA, 522 bp, Homo sapiens
  misc_feature: HEFZJCU01EC1PA.10.79.H02.1.454.heavy.3.raw
catagtagtgcacgaccggtgctcgatttagtgtcacacgaagggaaaggggagctctgggagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttgcctggttactttaccg

SEQ ID NO: 458461 - DNA, 525 bp, Homo sapiens
  misc_feature: HEFZJCU01A9MH9.48.34.D01.1.454.heavy.3.raw
agtatacatacacgaccggtgctcgatttagatcgtctgtgttgggtttggggatttagatgtctgtgttgggtttggggggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggcgccctgctccaggagcacctccgagagcacacgcggcccgtcgggctcgcctcggtcaaggactacttcccttatgtatta

SEQ ID NO: 458462 - DNA, 509 bp, Homo sapiens
  misc_feature: HEFZJCU01AZEEJ.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctaattactgtgcgagagtcccacgatccggtgagcctacgggcagccggccttttgactttcgtc

SEQ ID NO: 458463 - DNA, 535 bp, Homo sapiens
  misc_feature: HEFZJCU01EF9FD.16.39.D06.1.454.heavy.3.raw
tgtactactccacgaccggtgctcgatttagtgacatctcgcagttctttggggggagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccagccggggggtgtccctgagactctcctgtgcagcctctgggttcagcgtcagtaacaaccacgtgatgtgggtccgccagcctccagggaaggggctggaatgggtctcagttattgaaaatgatggtgacacaatctacgccgactccgtgaagggccgattcaccatctccagagacaattccaagaacacggtgaatcttcaaatgaacagcctgagaaccgaggacacggccgtatattattgtataggttatggtgtattcgggccctgggccagggaaccgtggtcaccgtctcctcagcctccaccg

SEQ ID NO: 458464 - DNA, 529 bp, Homo sapiens
  misc_feature: HEFZJCU01EHOD7.21.78.H01.1.454.heavy.3.raw
tcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctggggccggggaacctggtcaccgtctccccaccctccaccaac

SEQ ID NO: 458465 - DNA, 516 bp, Homo sapiens
  misc_feature: HEFZJCU01AZ60T.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcgtcagtggcgactacatgagctgggtccgccaggctccagggaagggcctggagtggatctcacttatttatagtcggtggtaccacatactacacagacttcgcgaggggcccgattcaccatctccagagacgattccaagaacaacgttcgtatcttcaatgaacagcctgacagtcgacgacacggccatgtatttttgtgtcgagcgacccggggctccgtcaatggctttcattctgggtccg

SEQ ID NO: 458466 - DNA, 470 bp, Homo sapiens; identical to SEQ ID NO: 444866
  misc_feature: HEFZJCU01D4E3I.4.36.D03.1.454.heavy.3.raw

SEQ ID NO: 458467 - DNA, 495 bp, Homo sapiens
  misc_feature: HEFZJCU01ET4KX.51.1.A01.1.454.heavy.3.raw
cgatcgtatacacgaccggtgctcgatttagacgtctcatcaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaatatatactatgtagactccgtgaagggccgattcatcatctccagagacaattccgagaacacgctgtatctgcaaatgaacagcctgagagttgaggacacggctgtgtattattgtgcgaacttaatcacggaggacaacggtccg

SEQ ID NO: 458468 - DNA, 524 bp, Homo sapiens
  misc_feature: HEFZJCU01EWLNX.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggctttgttctggggtccaggggaccctggtccatcgtctccccagcctccaccaagggcccatcggtcttcccctggcg

SEQ ID NO: 458469 - DNA, 385 bp, Homo sapiens
  misc_feature: HEFZJCU01AVBSK.13.42.D09.1.454.heavy.3.raw
tcacgtactacacgaccggtgctcgatttagacacatacgcagggaaaggggctggagtggattggggatatctcttatagtgggagtacgaactacaatccgtccctctaagagtcgagtcatcatatccgtagacaggtccaggaacgaattctccctgaaagtgagttctgtgaccgtcgcagacacggctgtctattattgtgcgagacggcaaatatggttcagggagttcgactactggggccagggaaccctggtcaccgtctcctcagcctccaccaagggcccatcggtcttccccctggcaccctcctccaagagcacctctgggggcacagcggccctgggctgcctggtcaaggactacttcctagtacgtga

SEQ ID NO: 458470 - DNA, 394 bp, Homo sapiens
  misc_feature: HEFZJCU01DGENK.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttcccctggcgccctgctccaggagcacctccgagagcacagcggccctgggctgcctggtcaaggactacttccgagtagtaca

SEQ ID NO: 458471 - DNA, 480 bp, Homo sapiens; identical to SEQ ID NO: 454318
  misc_feature: HEFZJCU01CG81R.9.36.D03.1.454.heavy.3.raw

SEQ ID NO: 458472 - DNA, 450 bp, Homo sapiens; identical to SEQ ID NO: 444893
  misc_feature: HEFZJCU01A9LRH.53.57.F02.1.454.heavy.3.raw

SEQ ID NO: 458473 - DNA, 524 bp, Homo sapiens
  misc_feature: HEFZJCU01EOPTY.49.34.D01.1.454.heavy.3.raw
agtcgagagacacgaccggtgctcgatttagatcgtctgtgttgggtttgggctgagctgggttttccttgttgctattttaaaaggtgtccagtgtgacgtgcaggtggtggagtctgggggaggcttggtccagcctggggggtccctgacactctcctgtatagtctctggattcaccgtcagtaacaactacatgagttgggtccgccaggctccagggaagggactggagtgggtctcagttatttatagcggtggtgacacatactacgcagactccgtgaagggcagattcaccatctccagagacggtttcaagaacacactctatcttcaaatgaacagcctgagagccgaggacacggctgtgtattactgtgcgagagatcccccgggtatagcagtgtctggtacatattactggggccagggaaccctggtcaccgtctcctcagcctccaccaaggcccatcggtcttcccctggcgccctgctccaggagcacctccgagagcacagcc

SEQ ID NO: 458474 - DNA, 501 bp, Homo sapiens; identical to SEQ ID NO: 453820
  misc_feature: HEFZJCU01DZNLF.3.20.B09.1.454.heavy.3.raw

SEQ ID NO: 458475 - DNA, 493 bp, Homo sapiens
  misc_feature: HEFZJCU01AGV61.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctggcaccctcctccaagagcacctctgggggcacagcggccctgggctgcctggtcaggactactcgagtagtaca

SEQ ID NO: 458476 - DNA, 437 bp, Homo sapiens; identical to SEQ ID NO: 444603
  misc_feature: HEFZJCU01EUCX2.3.21.B10.1.454.heavy.3.raw

SEQ ID NO: 458477 - DNA, 407 bp, Homo sapiens; identical to SEQ ID NO: 452434
  misc_feature: HEFZJCU01BF7TN.51.71.G05.1.454.heavy.3.raw

SEQ ID NO: 458478 - DNA, 503 bp, Homo sapiens
  misc_feature: HEFZJCU01AQETT.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctaccaaaaaccaggtggtccttacaatgaccaacatggaccctgtggacacagccacatattactgtgcacagagatacgggcagcacggtgggttggggtctacgtggggccacgggaaccctggtcaccgtctcctcacgcctccaaccg

SEQ ID NO: 458479 - DNA, 515 bp, Homo sapiens
  misc_feature: HEFZJCU01CVGS0.13.76.G10.1.454.heavy.3.raw
tcacgtactacacgaccggtgctcgatttagtcactcatacaggggcgtgggagaggagcccagcactgggtattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctggggaccg

SEQ ID NO: 458480 - DNA, 480 bp, Homo sapiens; identical to SEQ ID NO: 446171
  misc_feature: HEFZJCU01A9RNG.22.36.D03.1.454.heavy.3.raw

SEQ ID NO: 458481 - DNA, 524 bp, Homo sapiens
  misc_feature: HEFZJCU01D3EAD.12.71.G05.1.454.heavy.3.raw
  modified_base (369)..(369): a, c, t, g, unknown or other
  modified_base (467)..(467): a, c, t, g, unknown or other
atacgacgtacacgaccggtgctcgatttagtgtcgtcgcaagagagaggggaagacggatgggcccttggtggaggctgaggtgaaggagcctgggtcctcggtgaaggtctcctgcaaggcttctggagacaccttcaatagatattctgtcaattgggtgcgacaggcccctggacaaggatttgagtggatgggagggatcactcctgtcttcagaacctcaaaatacgcacagaggttccagggcagagtcaccattaccgcggacgaggccacgaagacagtctacatggaattgagcagcctgagatttgacgacacggccatgtattactgtgcgagggagggccagctgctgggagcgtntacatatttcgacccctggggccagggaacccaggtcaccgtctcctcagcctccaccaagggcccatccgtcttccccctggcgccctgctccaggngcacctccgagagcacagcggccctgggctggcctggtcaaggactacttccttacg

SEQ ID NO: 458482 - DNA, 513 bp, Homo sapiens
  misc_feature: HEFZJCU01C60SP.7.71.G05.1.454.heavy.3.raw
cgtgtctctacacgaccggtgctcgatttagtgtcgtcgcaagagagagggggggagaggagcccagcactagaagtcggcggtgtttccattcggtgatcagcactgaacacagaggactcaccatggagtttgggctgaactgggtttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaaatgaacagcctaagtcctgaggacacgggtgtatactactgtacgaaggaggggggaaccgagcgggagtcaagtactcctttg

SEQ ID NO: 458483 - DNA, 489 bp, Homo sapiens; identical to SEQ ID NO: 449646
  misc_feature: HEFZJCU01EABC1.18.70.G04.1.454.heavy.3.raw

SEQ ID NO: 458484 - DNA, 356 bp, Homo sapiens; identical to SEQ ID NO: 444460
  misc_feature: HEFZJCU01AUFZZ.47.38.D05.1.454.heavy.3.raw

SEQ ID NO: 458485 - DNA, 498 bp, Homo sapiens
  misc_feature: HEFZJCU01DDHTR.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgcgcagcctctggattcaccttcagtagttatagcatgaactgggtccgccaggctccagggaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctggaaccccgat

SEQ ID NO: 458486 - DNA, 505 bp, Homo sapiens
  misc_feature: HEFZJCU01CYPJU.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgatccggtgagcctacggcagcggcctttgacttcgtc

SEQ ID NO: 458487 - DNA, 402 bp, Homo sapiens
  misc_feature: HEFZJCU01BNZ4A.10.77.G11.1.454.heavy.3.raw
catagtagtgcacgaccggtgctcgatttagctagtcactcaagggaaaggggctggagtgggtctcaggtattagtggtagtggtgatggcacatactacgcagactccgtgaagggccggttcagcatctccagagacaattccaagaacacgttggatctacaaatgaacagcctgagagccgacgacacggccgtatattactgtgcgaaagatacgtggacacatgtatggtccgcggggggggcaatggacgtctggggccaagggaccacggtcaccgtctcctcagcctccaccaagggcccatcggtcttccccctggcaccctcctccaagagcacctctggggcacagcggccctgggctgcctggtcaaggactacttcccactactatg

SEQ ID NO: 458488 - DNA, 508 bp, Homo sapiens
  misc_feature: HEFZJCU01CY1SB.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaacgggcccatcggtcttccccctggccgccctgctccaggagcaccctccgagagcacagcggcccgtgggctgcctggcaaggactactcccactacta

SEQ ID NO: 458489 - DNA, 398 bp, Homo sapiens
  misc_feature: HEFZJCU01CAB7I.18.1.A01.1.454.heavy.3.raw
tacgagtatgcacgaccggtgctcgatttagacgtctcatcaaggaagggaaggggctggagtggatttcatacattagtagtgctggcaataccatcctctacgcagactctgtgaagggccggttcagcgtctccagggacaacgccaataacttttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctccttcaagagcacctctgggggcacagcggccctgggctgcctggtcaaggactacttcccatactcgta

SEQ ID NO: 458490 - DNA, 517 bp, Homo sapiens
  misc_feature: HEFZJCU01E1U19.13.61.F06.1.454.heavy.3.raw
tcacgtactacacgaccggtgctcgatttagctacgctctaagggaaagggggaggcttggtccagccgggggggtcactgagactctcctgtacagcctcgagattcattttcaggaattattggatgagttgggtccgccagtctccagggaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgacagttttccagacggcgactacgttgtcggctggggcgactttgacatttggggccaagggacactggtcaccgtctcccaagcttccaccaagggcccatcggtcttcccctggcgccctgctccaggacgcacctctgggggcacagcggccctgggctgcctggtcaaggactactccgtactagacg

SEQ ID NO: 458491 - DNA, 508 bp, Homo sapiens
  misc_feature: HEFZJCU01BUONQ.13.55.E11.1.454.heavy.3.raw
tcacgtactacacgaccggtgctcgatttagcactcgcacgttgggtttggggggtctcagagaggagccttagccctggactccaaggcctttccacttggtgatcagcactgagcacagaggactcaccatggaattggggctgagctgggtgctccttgttgctattttagaaggtggccagtgtgagatgcgactggtggagtctgggggaggcttggtccagccgggggggtcactgagactctcctgtacagcctcgagattcattttcaggaattattggatgagttgggtccgccagtctccagggaaggggctggagtgggtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgactagttttccagtacggccgg

SEQ ID NO: 458492 - DNA, 522 bp, Homo sapiens
  misc_feature: HEFZJCU01CAX85.48.5.A05.1.454.heavy.3.raw
agtatacatacacgaccggtgctcgatttagatagatagacagggggctctgagagaggagcccagccctgggattttcaggtgttttcatttggtgatcaggactgaacagagagaactcaccatggagtttgggttgagctggctttttcttgtggctattttaaaaggtgtccagtgtgaggtgcagctgttggagtctgggggaggcttggtacagccgggggggtccctgagactctcctgtgcaacctctggattcacctttaggggctatgccatgaactgggtccgccaggttcctgggaaggggctggagtgggtctcatctattagtgagactggtgatactacagactacgcagactccgtgagggccggttcaccgtctccagagacaattccaagaacacgctatttctgcaaatgaacagcctgagagtcgacgaccacggccgtatactactgtgcgagacagatgctgccgcctgttccgtggggccagggaaccctggtcaccgt

SEQ ID NO: 458493 - DNA, 506 bp, Homo sapiens; identical to SEQ ID NO: 444696
  misc_feature: HEFZJCU01A4BGB.16.34.D01.1.454.heavy.3.raw

SEQ ID NO: 458494 - DNA, 506 bp, Homo sapiens
  misc_feature: HEFZJCU01DY8DL.11.67.G01.1.454.heavy.3.raw
cgagagataccacgaccggtgctcgatttagagtatacatattgggtttggggagctctgagagaggagcccagccctgggattttcaggtgttttcatttggtgatcaggactgaacagagagagctcaccatggagtttgggctgagctggctttttcttgtggctattttaaaaggtgtccagtgtgaggtggagttattgcagtctgggggggggcttggtgcagccgagggggtccctgagactctcctgtgtaggctctggattcagttttagcagctacgccatgacctgggtccgccaggctccagggaaggggctgggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaatccgtaccagatattgcact

SEQ ID NO: 458495 - DNA, 511 bp, Homo sapiens; identical to SEQ ID NO: 445840
  misc_feature: HEFZJCU01AMOME.11.13.B02.1.454.heavy.3.raw

SEQ ID NO: 458496 - DNA, 513 bp, Homo sapiens
  misc_feature: HEFZJCU01BVA97.48.73.G07.1.454.heavy.3.raw
agtatacatacacgaccggtgctcgatttagctctacgctcaggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcaacctactacaacccgtccctcaaaagtcgaggcaccatatccgtagacacgtccaagaaccaattctccctgaagctgagctctgtgaccgccgcagacacggctgtctattactgtgcgaggccccgaggccgcagtggtcctttttgtatgcctttgaattatgtgggggccaagggtaccaagtggtctacccgg

SEQ ID NO: 458497 - DNA, 532 bp, Homo sapiens; identical to SEQ ID NO: 445228
  misc_feature: HEFZJCU01C55B9.7.78.H01.1.454.heavy.3.raw

SEQ ID NO: 458498 - DNA, 536 bp, Homo sapiens
  misc_feature: HEFZJCU01CLWJF.21.78.H01.1.454.heavy.3.raw
tcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggggcccggggaaccctggtccaccgtcctccccaccctcccaccaac

SEQ ID NO: 458499 - DNA, 532 bp, Homo sapiens
  misc_feature: HEFZJCU01EW080.48.44.D11.1.454.heavy.3.raw
agtatacatacacgaccggtgctcgatttagcgcagtacgaaggggctgggagaggagctccagccttgggactcccagctgtctccactcggtgatcggcactgaatacaggagactcaccatggagtttgggctgagctgggttttccttgttgctattttaaaaggtgtccagtgtgaggtgcagttggtgcagtccgggggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccac

SEQ ID NO: 458500 - DNA, 511 bp, Homo sapiens
  misc_feature: HEFZJCU01DF0X6.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatactggggccagggaaccctggtccgccg

SEQ ID NO: 458501 - DNA, 522 bp, Homo sapiens
  misc_feature: HEFZJCU01C1CAE.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaaggcccatcggtcttccccctggccg

SEQ ID NO: 458502 - DNA, 459 bp, Homo sapiens
  misc_feature: HEFZJCU01CKI1P.53.12.B01.1.454.heavy.3.raw
cgcgtatacacacgaccggtgctcgatttagtagtgtagattccgcgggcaccttgaccaactactatttacagtggttgcgacaggtccctggacaagggcttgagtggatgggaagaatcaaccctaatgatggaagtgcaacaaatgcgctgaaatttcagggcagaataaccctgaccagggacacgtccacgagcacagtctacatggaattgagcagcctaacatctgaagacacggccgtctattactgtgcgagagaatatcgtttatagtgggagctgccccaagatcgccattccactttgactactggggccagggaacactggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 458503 - DNA, 483 bp, Homo sapiens; identical to SEQ ID NO: 444924
  misc_feature: HEFZJCU01EX486.10.35.D02.1.454.heavy.3.raw

SEQ ID NO: 458504 - DNA, 403 bp, Homo sapiens; identical to SEQ ID NO: 445456
  misc_feature: HEFZJCU01BANVZ.3.72.G06.1.454.heavy.3.raw

SEQ ID NO: 458505 - DNA, 492 bp, Homo sapiens
  misc_feature: HEFZJCU01EV9TH.48.23.C01.1.454.heavy.3.raw
  modified_base (448)..(448): a, c, t, g, unknown or other
  modified_base (483)..(483): a, c, t, g, unknown or other
agtatacatacacgaccggtgctcgatttagtacacgtgattagggattggggacccaacaaccacatccctcctcagaagcccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcgcaacctacactatgcattgggtgcgccaggcccccggacaaagccttgagtggatgggtggctcaacgctggcgatggtcagacaaagtattcacagaagttccagggcagagtcaccatcaccagggacacgtcgcgagtagtgtcttcatggagctgcgcagtctgagatcggaagacacggcagtatattactgtntgagaggcggatattgtcgtcgaggtgactgctanagtcaaaat

SEQ ID NO: 458506 - DNA, 517 bp, Homo sapiens; identical to SEQ ID NO: 456451
  misc_feature: HEFZJCU01D2KSL.9.34.D01.1.454.heavy.3.raw

SEQ ID NO: 458507 - DNA, 519 bp, Homo sapiens; identical to SEQ ID NO: 444867
  misc_feature: HEFZJCU01EQYHR.9.34.D01.1.454.heavy.3.raw

SEQ ID NO: 458508 - DNA, 535 bp, Homo sapiens
  misc_feature: HEFZJCU01DV4CA.22.34.D01.1.454.heavy.3.raw
acatacgcgtcacgaccggtgctcgatttagatcgtctgtgttgggtttggggggaagaggaagactgacggtcctatcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacgtccaagaaccagttctccctgaaactgaggtctgtgaccgcagcggacacggccgtgtattactgtgcgagagagtccgggtccgatatctggccgttcgacccctgggccagggaaccctggtcaccgtctcctcagcctccaccaagggcccatcggtcttcccctggcgccctgctccaggagcacctccgagagcacagcggccctgggctgcctggtcaaggactacttcc

SEQ ID NO: 458509 - DNA, 522 bp, Homo sapiens; identical to SEQ ID NO: 446788
  misc_feature: HEFZJCU01BXZ1I.12.40.D07.1.454.heavy.3.raw

SEQ ID NO: 458510 - DNA, 392 bp, Homo sapiens; identical to SEQ ID NO: 444682
  misc_feature: HEFZJCU01EKKGL.16.70.G04.1.454.heavy.3.raw

SEQ ID NO: 458511 - DNA, 423 bp, Homo sapiens; identical to SEQ ID NO: 444772
  misc_feature: HEFZJCU01AKDYL.16.78.H01.1.454.heavy.3.raw

SEQ ID NO: 458512 - DNA, 509 bp, Homo sapiens
  misc_feature: HEFZJCU01CV9UA.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccaagggcccatcggtcttcccctggcaccctcctccaagagcacctctgggggcacagcggcctgggctgcctggtcaaggactacttccgtacta

SEQ ID NO: 458513 - DNA, 396 bp, Homo sapiens
  misc_feature: HEFZJCU01DUP7Y.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactgggccagggcactccggtcaccgtctcctcagcctccaccaagggcccatcggtcttccccctggcaccctcctccaagagcacctctgggggcacagcggccctgggctgccttggtcaaggactacttcccatactcgta

SEQ ID NO: 458514 - DNA, 503 bp, Homo sapiens
  misc_feature: HEFZJCU01B68MN.48.34.D01.1.454.heavy.3.raw
agtatacatacacgaccggtgctcgatttagatcgtctgtgttgggctctgggagacgagcccagcactggaagtcgccggtgtttccattcggtgctcagcactgaacacagaggactcaccatggagtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggaggg

SEQ ID NO: 458515 - DNA, 517 bp, Homo sapiens; identical to SEQ ID NO: 446608
  misc_feature: HEFZJCU01DQYO6.9.34.D01.1.454.heavy.3.raw

SEQ ID NO: 458516 - DNA, 409 bp, Homo sapiens
  misc_feature: HEFZJCU01AROO3.40.80.H03.1.454.heavy.3.raw
tctagcgactcacgaccggtgctcgatttagctgtgcgtcgaagggaaagggcatggagtgggtggccttcatcaggagcaaagccaacggtgggacagcacaatacgccgcgtctgtgagaggcagattctccgtctcaagagatgattctaagaacatcgtctatctgcaaatgaacagcctgacaaccgaggacacagcccaatatttttgtactacccaggatcagtatgagagacgtggtgtttctcagtattttgaatactggggccacggagcgctggtcatcgtctcctccgcctccaccaagggcccatcggtcttccccctggcaccctcctccaagagcacctctgggggcacagcggccctgggctgcctggtcaaggactacttccagtcgctaga

SEQ ID NO: 458517 - DNA, 504 bp, Homo sapiens
  misc_feature: HEFZJCU01C0ZCP.12.53.E09.1.454.heavy.3.raw
atacgacgtacacgaccggtgctcgatttagagagagtgtgttggggggagatgtggtccggcctggggggtccctgagactctcctgtgcagcctctcgattcagcttcagtaactatgctatgcactgggtccgccaggctccaggcagggggctggagtgggtggcagttatatcatatgatggaagacataaatactacgcagactccgtgaagggccgattcaccctctccagagacaattccaagaatacgctgtatatgcaaatgaacagcctgagacctgaggacacggctatgtattactgtgcgagaggaccattttggaatgcttattataccggaaacgcttttgatatttggggccaagggacaatggtcaccgtctcttcagcctccaccaagggcccatcggtcttcccctggcaccctcctccaagagcacctctgggggcacagcggccctgggctgcctggtcaaggactacttcctacgtcgtat

SEQ ID NO: 458518 - DNA, 513 bp, Homo sapiens
  misc_feature: HEFZJCU01EK7NC.52.34.D01.1.454.heavy.3.raw
cgcagtacgacacgaccggtgctcgatttagatcgtctgtgcaactgttggagtctgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttccccctggcaccctcctccaagagcacctctgggggcacagcggccctgggctgcctggtcaaggactacttcctatacgatcg

SEQ ID NO: 458519 - DNA, 396 bp, Homo sapiens; identical to SEQ ID NO: 444426
  misc_feature: HEFZJCU01ETPME.18.31.C09.1.454.heavy.3.raw

SEQ ID NO: 458520 - DNA, 502 bp, Homo sapiens; identical to SEQ ID NO: 445414
  misc_feature: HEFZJCU01CW9YU.17.25.C03.1.454.heavy.3.raw

SEQ ID NO: 458521 - DNA, 504 bp, Homo sapiens
  misc_feature: HEFZJCU01A4FMK.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtggggagcccgttgactactggggccagggaaccctggtcaccgtctcctcaacctccaccaagggcccatcggtcttcccctggcaccctcctccaagagcacctctgggggcacagcggccctgggctgcctggtcaaggactacttccgctacgtaga

SEQ ID NO: 458522 - DNA, 505 bp, Homo sapiens; identical to SEQ ID NO: 445664
  misc_feature: HEFZJCU01EDDGM.12.33.C11.1.454.heavy.3.raw

SEQ ID NO: 458523 - DNA, 500 bp, Homo sapiens
  misc_feature: HEFZJCU01BP051.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagccgcagtggtcttttgatgtccttgatatgtgggcgaagggacgaatggtcgaccgtc

SEQ ID NO: 458524 - DNA, 509 bp, Homo sapiens; identical to SEQ ID NO: 445070
  misc_feature: HEFZJCU01A4U3K.12.14.B03.1.454.heavy.3.raw

SEQ ID NO: 458525 - DNA, 518 bp, Homo sapiens
  misc_feature: HEFZJCU01BG83Z.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccgagggaactcgtggtcaccgtctccgcagcctccaccaaggcccatcc

SEQ ID NO: 458526 - DNA, 509 bp, Homo sapiens
  misc_feature: HEFZJCU01DWO5B.14.71.G05.1.454.heavy.3.raw
cgtctagtaccacgaccggtgctcgatttagtgtcgtcgcaagagagaggagcccagccctgggattttcaggtgttttcattcggtgatcaggactgaacagagagaactcaccatggagtttgggctgagcgtggcgttttcttaggtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaagggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagtatttttggagtggttattataccttttgacttc

SEQ ID NO: 458527 - DNA, 504 bp, Homo sapiens; identical to SEQ ID NO: 447065
  misc_feature: HEFZJCU01BVMM7.10.23.C01.1.454.heavy.3.raw

SEQ ID NO: 458528 - DNA, 522 bp, Homo sapiens
  misc_feature: HEFZJCU01DFR6V.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgcccgcggacacggccgtgtattactgtgcgaggtcgattgtgatggtaacaactgcttcttactcctttgaccagtggggccggggaaccctggtcaccgtctcttcagcctccaccaagggcccatcggtcttccccctggcaccctcctccaagagcacctctgggggcacaggcc

SEQ ID NO: 458529 - DNA, 393 bp, Homo sapiens
  misc_feature: HEFZJCU01CDW1P.48.75.G09.1.454.heavy.3.raw
agtatacatacacgaccggtgctcgatttagtatagacatcagggaaggccctggagtggcttgctctcatttactgggatactgatgaccgctacactccagctctgaaaacaggctcaccatcgccatggacacctccaaaaacaggtggtccttaaaatgaccaacatggacccaatggacagcgcgacatattactgtgcacacattgattgtggtcccaccaggtgtcccgggccctttgatatctggggccgggggacattcgtcaccgtctctgcagcctccaccaagggcccatcggtcttccccctggcgccctgctccaggagcacctccgagagcacagcggccctgggctgcctggtcaaggactacttcctatgtatact

SEQ ID NO: 458530 - DNA, 513 bp, Homo sapiens
  misc_feature: HEFZJCU01DPE7R.10.85.H08.1.454.heavy.3.raw
catagtagtgcacgaccggtgctcgatttagtatcactcagtcgcggggaggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctcgtggggccac

SEQ ID NO: 458531 - DNA, 520 bp, Homo sapiens; identical to SEQ ID NO: 453029
  misc_feature: HEFZJCU01APXUW.16.86.H09.1.454.heavy.3.raw

SEQ ID NO: 458532 - DNA, 504 bp, Homo sapiens; identical to SEQ ID NO: 445648
  misc_feature: HEFZJCU01EWKWB.17.25.C03.1.454.heavy.3.raw

SEQ ID NO: 458533 - DNA, 497 bp, Homo sapiens
  misc_feature: HEFZJCU01C1A80.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctgggccgtggcaccctgctgactgtctcctcagcctccaccaagggcccatcggtcttccccctggcgccctgctccaggagcacctccgagagcacagcggcccgtgggctgcctggtcaaggactac

SEQ ID NO: 458534 - DNA, 529 bp, Homo sapiens
  misc_feature: HEFZJCU01ETN4C.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccgagggaacccgtggtcaccgtctcctcagcttccaccaagggcccagtcggtccttcccccgtggccgcccgtcgctccaggacgcacctcgtcgggggcacgacgccggccc

SEQ ID NO: 458535 - DNA, 523 bp, Homo sapiens
  misc_feature: HEFZJCU01CRFMN.49.37.D04.1.454.heavy.3.raw
agtcgagagacacgaccggtgctcgatttagtagcatactgttgggtttgggggctctgggagaggagcccagcactagaagtcggcggtgtttccattcggtgatcagcactgaacacagaggactcaccatggagtttgggctgagctgggttttcctcgttgctcttttaagaggtgtcctttgtcgggtgcagttggtggaggtcggggggatctgtggtccggcctgggaagtccctgagactctcctgtactgcctccggattcaagttcgaaaattatggcttacactgggtccgccaggctccaggcaaggggctggagtgggtggcagtaatttcatatgattcaagtattggatattacgcagagtccgtaaagggccgattccaccatctccagagacaattcgaagaacaccatgtatctggaactgagcagagtcacatctgaggacacggctatgtattactgtgtagaaagtacttttatgacagtagtggtttctccgagtatgcac

SEQ ID NO: 458536 - DNA, 350 bp, Homo sapiens; identical to SEQ ID NO: 444420
  misc_feature: HEFZJCU01DT0M6.40.36.D03.1.454.heavy.3.raw

SEQ ID NO: 458537 - DNA, 518 bp, Homo sapiens; identical to SEQ ID NO: 450369
  misc_feature: HEFZJCU01DZEU9.7.78.H01.1.454.heavy.3.raw

SEQ ID NO: 458538 - DNA, 506 bp, Homo sapiens
  misc_feature: HEFZJCU01CFDY8.47.23.C01.1.454.heavy.3.raw
agctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggcccccggacagagacctgagtggatgggatggatcagcattggcaatggtaacataaacactcacagaagttccagggcagggtcaccattaccagagacatctccgcgaccacagcctacatggaactgagcagcctgacttctgaagacacggctatttactactgtgcgagagaggggtttgactggaactccttctacatggacgtcgtggggcaaagggaccg

SEQ ID NO: 458539 - DNA, 482 bp, Homo sapiens; identical to SEQ ID NO: 444904
  misc_feature: HEFZJCU01B9JCP.47.59.F04.1.454.heavy.3.raw

SEQ ID NO: 458540 - DNA, 518 bp, Homo sapiens; identical to SEQ ID NO: 444718
  misc_feature: HEFZJCU01C7TB8.9.34.D01.1.454.heavy.3.raw

SEQ ID NO: 458541 - DNA, 507 bp, Homo sapiens
  misc_feature: HEFZJCU01DYCKN.48.81.H04.1.454.heavy.3.raw
agtatacatacacgaccggtgctcgatttagtagtgtagattcgcggggagcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcgggggaggtggacggagctcggttttcggagttatcatctactacttt

SEQ ID NO: 458542 - DNA, 530 bp, Homo sapiens
  misc_feature: HEFZJCU01C9UFP.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggcagggaaccctggtcaccgtctcctcagcctccaccaaggg

SEQ ID NO: 458543 - DNA, 522 bp, Homo sapiens
  misc_feature: HEFZJCU01BG4ZG.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctcgtgggcc

SEQ ID NO: 458544 - DNA, 520 bp, Homo sapiens
  misc_feature: HEFZJCU01BSYCI.49.87.H10.1.454.heavy.3.raw
agtcgagagacacgaccggtgctcgatttagcagtactgcgttgggtttggggttgaagtgaagaagcctggggcctcggtgaaggtttcctgcaaggcatctggatacagcttgaccaactactatatacagtgggtgcgacaggcccctggacaagggcttgagtggatgggaagaatcaaccctaatgatggaagtacaacaaacgcgcagaaatttcagggcagaataaccctgaccagggacacgtccacgagcacagtctacatggaattgagcagcctgagatctgaagacacggccgtctattactgtgccagagaatatcgttttatagtgggagctgccccacgatcgccattccactttgactactggggccagggaacactggtcaccgtctcctcagcctccaccaaggcccatcggtcttcccctggcaccctcctccaagagcacctcgtgggggcacagcggccctgggctcgcctggtcaaggactacttccctctctcgact

SEQ ID NO: 458545 - DNA, 527 bp, Homo sapiens
  misc_feature: HEFZJCU01C85D3.13.55.E11.1.454.heavy.3.raw
tcacgtactacacgaccggtgctcgatttagcactcgcacgttgggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaataggtggtagcataggctatgcggactctgtgaagggccgattcaccatctccagagacaacgccaagaacctccctgtatctgcaaatgaacgctcgagagctgaggacgacgaccgtcgttagtatttgtgtacaacgaaagtactaccccttaaccgtacgttttagtttaggtaggtttacg

SEQ ID NO: 458546 - DNA, 488 bp, Homo sapiens
  misc_feature: HEFZJCU01A2FOC.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctcagagcacctccgagagcacagcggccctggctgcctggtcaaggactacttcccacgagagta

SEQ ID NO: 458547 - DNA, 522 bp, Homo sapiens; identical to SEQ ID NO: 446788
  misc_feature: HEFZJCU01BKICX.12.40.D07.1.454.heavy.3.raw

SEQ ID NO: 458548 - DNA, 530 bp, Homo sapiens
  misc_feature: HEFZJCU01B2BPX.18.59.F04.1.454.heavy.3.raw
tacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaatagacagcctgagaacgaggacacagccgtgtattactgtaccacatcccctgaaagcgtcaactactactactacggtatggacctcg

SEQ ID NO: 458549 - DNA, 525 bp, Homo sapiens
  misc_feature: HEFZJCU01DPKNE.52.75.G09.1.454.heavy.3.raw
cgcagtacgacacgaccggtgctcgatttagtatagacatcagggggagagaggagcccagccctgggattttcaggtgttttcatttggtgatcaggactgaacagagagaactcaccatggagtttgggctgagctggcttttcttgtggctattttaaaaggtgtccatggtgaggtgcggctgttggaatccggggggggcttgatacagcctggggggtccctgagactctcctgtgctgcctctggattcagtttcagtgacttagccatgagctgggtccgccaggctccagggagggctggaatggtctcagtcgttactgctggacttactaccacatactacgcagactccgtgaagggccggttcgccatctccagagacaattccaagaactaccctatatctgcaaatgagcagcctgagagccgaggacacggccgtatattactgtgcgatgggaagtaggttggttactactactagtttgacaactggggaccaggggaacccctggt

SEQ ID NO: 458550 - DNA, 448 bp, Homo sapiens; identical to SEQ ID NO: 451706
  misc_feature: HEFZJCU01B4800.9.53.E09.1.454.heavy.3.raw

SEQ ID NO: 458551 - DNA, 501 bp, Homo sapiens; identical to SEQ ID NO: 447719
  misc_feature: HEFZJCU01CXQ33.17.10.A10.1.454.heavy.3.raw

SEQ ID NO: 458552 - DNA, 396 bp, Homo sapiens; identical to SEQ ID NO: 444568
  misc_feature: HEFZJCU01CTCQO.47.46.E02.1.454.heavy.3.raw

SEQ ID NO: 458553 - DNA, 482 bp, Homo sapiens; identical to SEQ ID NO: 444503
  misc_feature: HEFZJCU01CBVOU.7.10.A10.1.454.heavy.3.raw

SEQ ID NO: 458554 - DNA, 514 bp, Homo sapiens; identical to SEQ ID NO: 452375
  misc_feature: HEFZJCU01D4YEV.10.59.F04.1.454.heavy.3.raw

SEQ ID NO: 458555 - DNA, 497 bp, Homo sapiens
  misc_feature: HEFZJCU01BDG9Y.10.21.B10.1.454.heavy.3.raw
catagtagtgcacgaccggtgctcgatttagtgtcgtcgcagagagagggggagctctgggagaggagcccagcactagaagtcggcggtgcctccattcggtgatcagcactgaacacagaggactcaccatggagttttgggctgagcgtgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttatactgtgggagaaatcctagtggcac

SEQ ID NO: 458556 - DNA, 492 bp, Homo sapiens
  misc_feature: HEFZJCU01ESCBM.4.7.A07.1.454.heavy.3.raw
agcactgtagcacgaccggtgctcgatttagcacgtgtcgcaggggctgagagaggagcccagccctgggattttcaggtgttttcatttggtgatcaggactgaacagagagaactcaccatggagtctgggctgagctggcttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccagggaaggggctggaatgggtctcatctattagtgctactactggtggcacatacttcgcagactccgtgaagggccggttctccatctccagagacaattccaagaacaacgctgtatctgcaattgaacagcctgagagccgaggacacggccgtatattactgtgcgaaagatttggggaatgaccactc

SEQ ID NO: 458557 - DNA, 518 bp, Homo sapiens; identical to SEQ ID NO: 447436
  misc_feature: HEFZJCU01C2XDR.13.76.G10.1.454.heavy.3.raw

SEQ ID NO: 458558 - DNA, 521 bp, Homo sapiens
  misc_feature: HEFZJCU01AM2PF.52.53.E09.1.454.heavy.3.raw
cgcagtacgacacgaccggtgctcgatttagagagagtgtgttgggtttgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccgaggggggcgggagcagccccgtaacttctggggccagggaaccc

SEQ ID NO: 458559 - DNA, 506 bp, Homo sapiens
  misc_feature: HEFZJCU01DDWTV.53.34.D01.1.454.heavy.3.raw
cgcgtatacacacgaccggtgctcgatttagatcgtctgtgttgggtttgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccagggaaccctggtcaccgtctcctcagcttccaccaagggcccatcggtcttcccctggcgccctgctccaggagcacctctgggggcacagcggccctgggctgcctggtcaaggactacttcctcgtact

SEQ ID NO: 458560 - DNA, 486 bp, Homo sapiens; identical to SEQ ID NO: 444861
  misc_feature: HEFZJCU01AGY8K.47.55.E11.1.454.heavy.3.raw

SEQ ID NO: 458561 - DNA, 525 bp, Homo sapiens
  misc_feature: HEFZJCU01E0PH1.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacgggccgtgtattactgtgcgagagaggccgtttattttacggaccagctagttaaaactccttactacggtctggacgtcgtggggccgaggggaccaac

SEQ ID NO: 458562 - DNA, 523 bp, Homo sapiens
  misc_feature: HEFZJCU01BN27W.40.33.C11.1.454.heavy.3.raw
tctagcgactcacgaccggtgctcgatttagagtgagctcgttgggtttgggtgctcgatttagagtgagctcgttgggtttgggaggcttagttcagcctggggggtccctgagactctcctgtgcagcctctggagtcactctctccgcctactgggtactctgggtccgccaagctccagggaaggggctggagtgggtcgcacgtatttataaagatggatccacagcgtacgcggactccgtgaagggccgattcaccatctccagagacaatgccaagaacacagtgtctctgcaaatggacagtctgagagccgaggacacgggtgtctattattgtacaaaagtggggactaatgaatatggtgtggacgtctggggccaagggaccacggtcgtcgcctcttatgcctccaccaagggcccatcggtcttccccctggcgccctgctccaggagcacctccgagagcacagcggccctgggctgcctggtcaaggactacttccagtcgctaga

SEQ ID NO: 458563 - DNA, 506 bp, Homo sapiens
  misc_feature: HEFZJCU01CVUMZ.49.23.C01.1.454.heavy.3.raw
agtcgagagacacgaccggtgctcgatttagtacacgtgattagggattggggagcatcacataacaaccagattcctcctctaaagaagcccctgggagcacagctcatcaccatggactggacctggaggttcctctttgtggtggcagcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactatttcatggaactgagcagcctcagatccgaggacacggccgtttactactgtgcgagcgatcccggattcccgcgtttcgaggatgactactggggccac

SEQ ID NO: 458564 - DNA, 495 bp, Homo sapiens; identical to SEQ ID NO: 454998
  misc_feature: HEFZJCU01AP7B2.40.1.A01.1.454.heavy.3.raw

SEQ ID NO: 458565 - DNA, 505 bp, Homo sapiens
  misc_feature: HEFZJCU01C5ZQD.16.71.G05.1.454.heavy.3.raw
  modified_base (162)..(162): a, c, t, g, unknown or other
tgtactactccacgaccggtgctcgatttagtgtcgtcgcaagagagaggagcccagccctgggattttcaggtgttttcatttggtgatcaggactgaacagagagaactcaccatggagtctgggctgagcgtgcgttttctaggtggctatttaaaggngtcagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgaagagccgacgacacggccatatattactgtgcgaaagcaaccggcagttatcacccatactctttgactactgggg

SEQ ID NO: 458566 - DNA, 544 bp, Homo sapiens
  misc_feature: HEFZJCU01DIWPI.48.3.A03.1.454.heavy.3.raw
agtatacatacacgaccggtgctcgatttagagagcgtcacagggggctctgagagaggagcccagccctgggattttcaggtgttttcacttggtgatcaggactgaacagagagaactcaccatggagtttgggctgagctggctttttcttctggccattttaaaaggtgtccagtgtgaggagcagttgtcggaatctgggggagacctggtacagccgggggggtccctgacactctcctgtgtggcctctggattcatttttagcaaccacgccattacctgggtccgccacgagtccagggaagggactggacggaggtcgcgggtataagtggttttagtggaagtagattatacgcagagtccgtaaggggccggttcaccgatctccagagacaattccaagaacacggcatatctacaaatgaacaacctgggcgccgaagacacggccgtctattactgtgcgagatcctctactagtgccgcgaggtacttgaactctggggtcagggaaccctgggtcaccgtctcctca

SEQ ID NO: 458567 - DNA, 515 bp, Homo sapiens
  misc_feature: HEFZJCU01CTQPI.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagcgtgcgtttctaggtcggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacgggccatataattactgtgcgaaagcaccggcagttagtcacccatactactttgactactggggccaac

SEQ ID NO: 458568 - DNA, 539 bp, Homo sapiens
  misc_feature: HEFZJCU01ADXGK.14.57.F02.1.454.heavy.3.raw
  modified_base (385)..(385): a, c, t, g, unknown or other
  modified_base (393)..(393): a, c, t, g, unknown or other
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgngtgaaagntacgaagtctatgatacccaatttgggaggggccgtttcatgtctggggccaagggacgctggtcaccgtctcttcagcctccaccaagggcccatcggtcttcccctggcaccctcctccaagagcacctctgggggcacgagcc

SEQ ID NO: 458569 - DNA, 501 bp, Homo sapiens; identical to SEQ ID NO: 453035
  misc_feature: HEFZJCU01DEE7A.3.20.B09.1.454.heavy.3.raw

SEQ ID NO: 458570 - DNA, 518 bp, Homo sapiens; identical to SEQ ID NO: 445453
  misc_feature: HEFZJCU01BALPM.9.34.D01.1.454.heavy.3.raw

SEQ ID NO: 458571 - DNA, 507 bp, Homo sapiens
  misc_feature: HEFZJCU01DF6FB.53.81.H04.1.454.heavy.3.raw
cgcgtatacacacgaccggtgctcgatttagtagtgtagattcgcggggtctgggagacgagcccagcactggaagtcgccggtgtttccattcggtgatcatcactgaacacagaggactcaccatggagtttgggctgagctgggttttcctcgttgctcttttaagaggtgtccagtgtcaagtgcaactggtggagtctgggggaggcgtggtccagcctggggggtccctgagactctcctgtgcagcctctggattcaccttcagcacctatcctatgcactgggtccgccaggctccaggcaagggactggagtgggtggcagttatatcatttgatggaagcactacatactacgcaaactccgtgaagggccgattcaccatctccagagacgattccaggaacactctgtttctccaaatgaacagcctgagagctggaggacacggcttctttattactgtgcgagagtattcgtggatacagcctatttattacg

SEQ ID NO: 458572 - DNA, 524 bp, Homo sapiens; identical to SEQ ID NO: 446401
  misc_feature: HEFZJCU01CXN73.3.82.H05.1.454.heavy.3.raw

SEQ ID NO: 458573 - DNA, 532 bp, Homo sapiens
  misc_feature: HEFZJCU01BYYKG.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccagggaagggctggagtgggtctctactattactgctagtggtaatcatgcatactatgcagactccgtgaagggccggttcaccttcaccagagacaattccaagaacacgctctatctgcaattgaccagcctgagcgccgaggacacggccatgtattactgtactaaatcgcgggtggccgcggccggtacctcggactggttttgtattttctggggtccgaagggaacg

SEQ ID NO: 458574 - DNA, 504 bp, Homo sapiens
  misc_feature: HEFZJCU01DGR8S.53.34.D01.1.454.heavy.3.raw
cgcgtatacacacgaccggtgctcgatttagatcgtctgtgttgggtttggggggagaggagcccagcactgggattccgaggtgtttccattcggtgatcagcactgaacacagaggactcaccatggagttttggctgagctggttttccttgttgctattttaaaaggtgtccagtgtgaggtgcagctggtggagtctggaggaggcttggtccagcctggggggtccctgagactctcctgtgcagcctctggattgaccgtcagtagcaactacatgagctgggtccgccaggccccagggaaggggctggagtgggtctcaacaatttatagcggtggtaggacataccacgcagaccccgtgaagggccgattcaccatctccagacacaattccaagaacacactgtttcttcaaatggacttcctgagaactgaggacacggccgtgtattactgcgcgagagtgcatgatagtggttccatgatgcttttgat

SEQ ID NO: 458575 - DNA, 512 bp, Homo sapiens; identical to SEQ ID NO: 451977
  misc_feature: HEFZJCU01DO61G.48.34.D01.1.454.heavy.3.raw

SEQ ID NO: 458576 - DNA, 516 bp, Homo sapiens
  misc_feature: HEFZJCU01BN3G7.52.35.D02.1.454.heavy.3.raw
cgcagtacgacacgaccggtgctcgatttagcacacgatagttgggtttggggacccaacaaccacatccctcctcagaagccccccagagcacaacgcctcaccatggactggacctggaggatcctctttttggtggcagcagccacaggtggccactcccaggtccagcttgtgcagtctggggctgaggtgaagaagcctggggcctcagtgaaggtttcctgcaaggcctctggatacaccttcagtgacaatactttgcattgggtgcgccaggcccccggacaagggcttgtttggatgggatggatcaacgctggcaatggtaacacaaaatattacacagaagttccagggcagagtcaccatcaccagggacacatccgcgagcacagcctacatggagttgagcagcctgagaaatgaagacacggctgtatattactgtgcgagaggggaaatggcctccaccaagggcccatcggtcttccccctggcacccctcctccaacg

SEQ ID NO: 458577 - DNA, 486 bp, Homo sapiens
  misc_feature: HEFZJCU01C14RL.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttccccctggcgccctgctccaggagcacctccgagagcacagcggccctgggctgcctggtcaaggactacttcccacgta

SEQ ID NO: 458578 - DNA, 539 bp, Homo sapiens; identical to SEQ ID NO: 456471
  misc_feature: HEFZJCU01ENQFC.12.85.H08.1.454.heavy.3.raw

SEQ ID NO: 458579 - DNA, 515 bp, Homo sapiens
  misc_feature: HEFZJCU01DLYLB.51.62.F07.1.454.heavy.3.raw
cgatcgtatacacgaccggtgctcgatttagtagtcgcataaagggaaaggggaaccagattcctcctctaaagaagcccctgggagcacagttcatcaccatggactggacctggaagttcctctttgtggtggcagcagcaacaggtgtccagtcgcaggtccagctggtgcagtctgggactgaggtgaagaggcctgggtcctcgatgaaggtctcctgcaaggcatctaaaaacatcttaagaagttatgacatcgcctgggtgcgacaggcccctggacatgggcttgagtgggtgggcaggatcatccctatgtttggagtcgcaaactacgcacagaagtccgggcaaagtcacgttgaccgcggacacagtcacggacacagcctacatggaactcaacggcctcagatttgaggacacggccgtctattattgtgcgagagtgagaaattacggtggctactcccttgactactggggccagggaaccctggtcaccgtctcctc

SEQ ID NO: 458580 - DNA, 511 bp, Homo sapiens
  misc_feature: HEFZJCU01A91K9.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctactggggcccgggagccctggtcc

SEQ ID NO: 458581 - DNA, 532 bp, Homo sapiens; identical to SEQ ID NO: 449262
  misc_feature: HEFZJCU01CLO22.7.78.H01.1.454.heavy.3.raw

SEQ ID NO: 458582 - DNA, 396 bp, Homo sapiens; identical to SEQ ID NO: 444469
  misc_feature: HEFZJCU01DXM0Q.47.46.E02.1.454.heavy.3.raw

SEQ ID NO: 458583 - DNA, 500 bp, Homo sapiens
  misc_feature: HEFZJCU01D91NE.40.55.E11.1.454.heavy.3.raw
tctagcgactcacgaccggtgctcgatttagcactcgcacgttgggtttggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgtagtgcctttgatatgtggggccgaagggacaagt

SEQ ID NO: 458584 - DNA, 535 bp, Homo sapiens
  misc_feature: HEFZJCU01ERQ67.16.87.H10.1.454.heavy.3.raw
tgtactactccacgaccggtgctcgatttagcagtactgcgttgggtttgggggagccccagccctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggaagggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaactagttatgggttggggggtagtttggggtttttttttcgtacgttacgggt

SEQ ID NO: 458585 - DNA, 493 bp, Homo sapiens; identical to SEQ ID NO: 450212
  misc_feature: HEFZJCU01DDQCT.13.71.G05.1.454.heavy.3.raw

SEQ ID NO: 458586 - DNA, 509 bp, Homo sapiens; identical to SEQ ID NO: 454772
  misc_feature: HEFZJCU01BBNFY.4.67.G01.1.454.heavy.3.raw

SEQ ID NO: 458587 - DNA, 500 bp, Homo sapiens; identical to SEQ ID NO: 446033
  misc_feature: HEFZJCU01A6ME9.11.27.C05.1.454.heavy.3.raw

SEQ ID NO: 458588 - DNA, 505 bp, Homo sapiens
  misc_feature: HEFZJCU01E2DEO.22.36.D03.1.454.heavy.3.raw
acatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaagacctctattttggtccgtcggccgactact

SEQ ID NO: 458589 - DNA, 494 bp, Homo sapiens
  misc_feature: HEFZJCU01CE7WD.48.23.C01.1.454.heavy.3.raw
agtatacatacacgaccggtgctcgatttagtacacgtgattagggattggggacccaacaaccacatccctcctcagaagcccccagagcacaactccgtaccatggactggacctggaggatcctctttttggtggcagcagccacaggtgcccactcccaggtccagcttgtgcaatctgggactgaactgaagaagcccgggggctctgtgagggtttcatgcaaggcctctggatactcgttcacaacctacactatgcattgggtgcgccaggcccccggacaaagccttgagtggatggggtggctcaacgctggcgatggtcagacaaagtattcacagaagttccagggcagagtcaccatcaccagggacacgtccgcgagtagtgtcttcatggagctgcgcagtctgagatcggaagacacgggcagtatattactgtgcgagaggcggatattgtcgtcgaggtgactgctacagtcaaat

SEQ ID NO: 458590 - DNA, 507 bp, Homo sapiens; identical to SEQ ID NO: 444486
  misc_feature: HEFZJCU01AGT7E.4.67.G01.1.454.heavy.3.raw

SEQ ID NO: 458591 - DNA, 522 bp, Homo sapiens
  misc_feature: HEFZJCU01EU242.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggacctggtcatcgtctccccagcctccaccaagggcccatcggtcttccccctggccg

SEQ ID NO: 458592 - DNA, 493 bp, Homo sapiens
  misc_feature: HEFZJCU01CINHE.14.23.C01.1.454.heavy.3.raw
cgtctagtaccacgaccggtgctcgatttagtacacgtgattagggattggggccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcactttcagcacctatgctatcaactgggtgcgacaggcccctggacaagggcttgagtggatgggaggaatcatccctatgtttggtacaactaactacacacagaagttccagggcagagtcacgattaccgcggacgaatccacgagcacagcctacatggagctgagcagcctgagatctgacgacacggccgtgtattactgtgcgagggcctggttctcagtgctgttgagatgggccgaggacgtctggtcaccgtctcctcacgctccaccg

SEQ ID NO: 458593 - DNA, 485 bp, Homo sapiens
  misc_feature: HEFZJCU01D9O7Y.49.33.C11.1.454.heavy.3.raw
agtcgagagacacgaccggtgctcgatttagagtgagctcgttgggtttggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcttgtgcagcctctggattcaccttcagggtctatgacatgcactgggtccgccaggctccaggcaaggggctggagtgggtggcagttatatcatatgatggaagcaagatatactatgtagactccgtgaagggccgattcatcatctccagagacaactccgagaacacgctgtatctgcaaatgaacagggctgagagctgaagacacggctgtatattactgtgcgaacttaa

SEQ ID NO: 458594 - DNA, 500 bp, Homo sapiens; identical to SEQ ID NO: 445080
  misc_feature: HEFZJCU01CBUY6.3.81.H04.1.454.heavy.3.raw

SEQ ID NO: 458595 - DNA, 522 bp, Homo sapiens
  misc_feature: HEFZJCU01CBSW6.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctgggtcatcgtctccccagcctccaccaagggcccatcggtcttcccctggcg

SEQ ID NO: 458596 - DNA, 507 bp, Homo sapiens
  misc_feature: HEFZJCU01ECKUI.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagccggccctgggctgcctggtcaaggctacttccctatgtatactctgac

SEQ ID NO: 458597 - DNA, 486 bp, Homo sapiens
  misc_feature: HEFZJCU01BFGNJ.52.54.E10.1.454.heavy.3.raw
cgcagtacgacacgaccggtgctcgatttagatcgtagcagaacacacaaagggggagactgagtgtgagtgaacatgagtgagaaaactggatttgtgtggcagtttctgaaaacggtgtccttctgtttgcaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcacttatatcctatgatggaagcaataagcactacgcagagtccgtgaagggccgattgaccatctccagagacaactcgaagaatacggttcttctacaatgaacagcctgagagctgaggacacggctatcttttactgtgcgagagggaactcgattacagcagccctcgaagacatcatgatggctttgat

SEQ ID NO: 458598 - DNA, 512 bp, Homo sapiens
  misc_feature: HEFZJCU01DEX5Q.9.70.G04.1.454.heavy.3.raw
  modified_base (349)..(349): a, c, t, g, unknown or other
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagngtcgagtcagcatgtcagtcgacacgtcccagaaccagttctccctgacagtgagttatatgaccgccgcagacacggccgtgtattactgtgcgagagaggccgttattttaggaccagctgttaaaaactcctactacggtctggacgtctgggccagggg

SEQ ID NO: 458599 - DNA, 521 bp, Homo sapiens
  misc_feature: HEFZJCU01DM0XJ.4.33.C11.1.454.heavy.3.raw
  modified_base (443)..(443): a, c, t, g, unknown or other
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggttcattagagccatggcttatgctgggacaacagaatacgccgcgtctgtgaaaggcagattcatcatctcaagagatgattccaacggcatcgcctatctgcagatgaacancctgaagaccgaggacacagccgtctattactgtggttagggtaggttttacgtatttttggaggttggatatttaaa

SEQ ID NO: 458600 - DNA, 371 bp, Homo sapiens; identical to SEQ ID NO: 444435
  misc_feature: HEFZJCU01DMF2Q.3.42.D09.1.454.heavy.3.raw

SEQ ID NO: 458601 - DNA, 505 bp, Homo sapiens
  misc_feature: HEFZJCU01CQHDI.10.38.D05.1.454.heavy.3.raw
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttccccctgcgccctgctccaggagcacctccgagagcacagcggccctgggctgcctggtcaaggactacttcccactacta

SEQ ID NO: 458602 - DNA, 513 bp, Homo sapiens
  misc_feature: HEFZJCU01DBLD6.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggactacttccgagtgcgtct

SEQ ID NO: 458603 - DNA, 505 bp, Homo sapiens
  misc_feature: HEFZJCU01B5G7K.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaaggggactgacatctgacgacacggccatgtattattgtgcgagagaaatgtaggtactgctttgggtcctggggcccgggaaccgggtcg

SEQ ID NO: 458604 - DNA, 539 bp, Homo sapiens
  misc_feature: HEFZJCU01BYT4Q.48.40.D07.1.454.heavy.3.raw
agtatacatacacgaccggtgctcgatttagtgatagagcgtaacaacagagggggagccccagacctgggattcccagctgtttctgcttgctgatcaggaccgcacacagagagctcaccatggagttggggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactgggtccgccaagctccagggaaggggctggagtgggtctcaaacgtgaacgttgatggcgggatcacaaaatacgcggactccgtgaaaggccgcttcaccgtctccagagacaacggcgagaatactctgtatttgcagatgagaaatctgagaggcgaggacaccgcgctttattattgtacaacgtcgttttacttttctaatggtggctcttacgaacgacatgactagttggggtcggggaaccctggt

SEQ ID NO: 458605 - DNA, 528 bp, Homo sapiens
  misc_feature: HEFZJCU01BBL99.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatcttcaaatagacagcctgagaccagacgacacggctgtctattattgcgcgagagagacacacgaacctactggccaatactatgggggcttgttctggggccagggggaccctggtcatcgtctccccagcctccaccaagggcccatcggtcttccccctggcgccctg

SEQ ID NO: 458606 - DNA, 509 bp, Homo sapiens; identical to SEQ ID NO: 444586
  misc_feature: HEFZJCU01DF9LX.12.78.H01.1.454.heavy.3.raw

SEQ ID NO: 458607 - DNA, 323 bp, Homo sapiens; identical to SEQ ID NO: 458105
  misc_feature: HEFZJCU01AQQWE.49.10.A10.1.454.heavy.3.raw

SEQ ID NO: 458608 - DNA, 521 bp, Homo sapiens
  misc_feature: HEFZJCU01A2RGA.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgacccctggggccagggaaccctggtcaccgtctcctcagcc

SEQ ID NO: 458609 - DNA, 516 bp, Homo sapiens; identical to SEQ ID NO: 457788
  misc_feature: HEFZJCU01CFOHV.26.57.F02.1.454.heavy.3.raw

SEQ ID NO: 458610 - DNA, 511 bp, Homo sapiens
  misc_feature: HEFZJCU01B4HML.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggacacttccgagtgcgtct

SEQ ID NO: 458611 - DNA, 519 bp, Homo sapiens; identical to SEQ ID NO: 444867
  misc_feature: HEFZJCU01E141P.9.34.D01.1.454.heavy.3.raw

SEQ ID NO: 458612 - DNA, 530 bp, Homo sapiens; identical to SEQ ID NO: 445939
  misc_feature: HEFZJCU01DYOXA.12.39.D06.1.454.heavy.3.raw

SEQ ID NO: 458613 - DNA, 486 bp, Homo sapiens; identical to SEQ ID NO: 445770
  misc_feature: HEFZJCU01BV6KB.3.75.G09.1.454.heavy.3.raw

SEQ ID NO: 458614 - DNA, 507 bp, Homo sapiens
  misc_feature: HEFZJCU01BM2B2.49.59.F04.1.454.heavy.3.raw
agtcgagagacacgaccggtgctcgatttagtacacacacttagggattggggagcatcacataacaaccagattcctcctctaaagaagcccctgggagcacagctcatcaccatggactggacctggaggttcctctttgtggtggcagcagctacaggtgtccagtcccaggtccagctggtgcaatctggggctgaggtgaagaagcctgggtcctcggtgaaggtctcctgtaaggcttctggaggcaccctcagcagttatactatgaattgggtgcgacaggcccctggacaagggcttgagtggatggggaggatcatccctattgttggtgtgacaaactacgcacagaagttccaggacagaatcacgataaccgcggacacatccacgagcactattttcatggaactgagcagcctcagatccgaggacacggccgtttactactgtgcgagcgatcccggattcccgcgtttcgaggatgactactggggccac

SEQ ID NO: 458615 - DNA, 390 bp, Homo sapiens; identical to SEQ ID NO: 455839
  misc_feature: HEFZJCU01AK7KE.16.24.C02.1.454.heavy.3.raw

SEQ ID NO: 458616 - DNA, 518 bp, Homo sapiens
  misc_feature: HEFZJCU01CMUF5.4.23.C01.1.454.heavy.3.raw
agcactgtagcacgaccggtgctcgatttagtacacgtgattagggattggggacccaaaaaccacacccctccttgggcgaatcccctagatcacagctcctcaccatggactggacctggagcatccttttcttggtggcagcagcaacaggtgcccactcccaggttcacctggagcagtctggacctgaggtgaagaagcctggggcctcagtgaaggtctcctggcaaggcttctggctacacctttaccacctatggtgtcaactgggtgcgacaggcccctggacaagggcttgagtggatgggatggatcagcgcttacaatgggaacacaaactatgcacagacgttccagggcagagtcaccattaccacagacacatccacgagcacagcctacatggacctgaggagcctgagatttgacgacacggccatatattactggtgcgagagattgggccgacggaaaccttgactacgtgggggccaggggaacccctggtcaccggt

SEQ ID NO: 458617 - DNA, 506 bp, Homo sapiens
  misc_feature: HEFZJCU01BP03L.53.25.C03.1.454.heavy.3.raw
cgcgtatacacacgaccggtgctcgatttagtagtgtagatttgggtttggggtctgagagaggagccttagccctggattccaaggcctctccacttggtgatcagcacttagcaccgaggattcaccatggaactggggctccgctgggttttccttgttgcttttttagaaggtgtccagtgtgacatgcagctggtggagtctgggggaggcctggtcaagccggggggtccctgagactctcctgtgcagcctctggattcaccttcagtatttatagcatgaattggatccgccaggctccagggaagggctcgagtgggtctcatccattagtagtagtagtagttacaaatactacgcagactcagtgaagggccgattcaccgtctccagagacaacgccaagaactcactgtatctgcaaatgaatagcctgagagccgaggacacggctgtatatttctgtgcgagagatagacccatataacagtagactacta

SEQ ID NO: 458618 - DNA, 499 bp, Homo sapiens
  misc_feature: HEFZJCU01EZAT4.40.37.D04.1.454.heavy.3.raw
tctagcgactcacgaccggtgctcgatttagtagcatactgttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccggggaatcctggtcaccgtctcctcagcctccaccaagggcccatcggtccttcccctggcgccctgcctccaggagcacctccgagagcacagcggccctgggctgcctggtcaaggactacttccagtcgctaga

SEQ ID NO: 458619 - DNA, 531 bp, Homo sapiens
  misc_feature: HEFZJCU01BDMHV.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctggggcccgggaaccctggtcaccgtctcctcagcctccaccaacgggcccatcggtcttcccctggccaccctcctcc

SEQ ID NO: 458620 - DNA, 518 bp, Homo sapiens
  misc_feature: HEFZJCU01DEQPQ.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgagggggccgattcaccatctccagagacaattccaagaacacgctgtttctcaaatgaacagcctgagagccgatgacacggccgtgtattactgtgcgagagatggggcccacgaacgttactacgctatggacgtctggggccaagggacc

SEQ ID NO: 458621 - DNA, 395 bp, Homo sapiens; identical to SEQ ID NO: 444517
  misc_feature: HEFZJCU01EM7P5.16.68.G02.1.454.heavy.3.raw

SEQ ID NO: 458622 - DNA, 382 bp, Homo sapiens; identical to SEQ ID NO: 455903
  misc_feature: HEFZJCU01ERQ6M.19.80.H03.1.454.heavy.3.raw

SEQ ID NO: 458623 - DNA, 379 bp, Homo sapiens; identical to SEQ ID NO: 444450
  misc_feature: HEFZJCU01C6XNH.47.77.G11.1.454.heavy.3.raw

SEQ ID NO: 458624 - DNA, 492 bp, Homo sapiens
  misc_feature: HEFZJCU01BRYO7.10.34.D01.1.454.heavy.3.raw
catagtagtgcacgaccggtgctcgatttagatcgtctgtgttgggtcccttagactctcctgtgcagcctctggattcactttcagtaacgcctggatgaactgggtcctccaggctccagggaaggggctggagtgggttggccatattaaaatcaaagctgatggtgggacaacagagcacgctgcacccgtgaaaggcagattcagcatctcaagagatgattcaaaaagtacgctgtatctgaacatgaacagcctgaaaacggaggacacagccgtgtattactgtgccactcaggaccgatattgtttctgatggcgtatgctctaaggaggaccttgacttctggggccagggaaccctggtcaccgtctcctcagcctccaccaaggcccatcggtcttcccctggcgccctgctccaggagcacctccgagagcacagcggccctgggctgcctggtcaaggactacttcccactacctatg

SEQ ID NO: 458625 - DNA, 530 bp, Homo sapiens
  misc_feature: HEFZJCU01C7ELC.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaaattccaggaacacattgtatcttcaaatgaataacctgagagccgaggacacggccatgtattactgtgtggggcatttacttgaccctggggccggggaaccctggtcaccgtcctccccaccctccaccg

SEQ ID NO: 458626 - DNA, 506 bp, Homo sapiens
  misc_feature: HEFZJCU01D6OC3.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagtttgtttcatctgagggcagtgttcaatggtatgcagactccgtgaagggccgattcaccatctccagagacaattccaggaacacaatgtatttggagctgaacagcctaagtcctgagacacgggcgtatactactgtacgaaggagggggaaccagcggagtccagtactcctttg

SEQ ID NO: 458627 - DNA, 519 bp, Homo sapiens; identical to SEQ ID NO: 446228
  misc_feature: HEFZJCU01CHAS3.9.43.D10.1.454.heavy.3.raw

SEQ ID NO: 458628 - DNA, 316 bp, Homo sapiens; identical to SEQ ID NO: 444479
  misc_feature: HEFZJCU01A4L1E.47.84.H07.1.454.heavy.3.raw

SEQ ID NO: 458629 - DNA, 521 bp, Homo sapiens
  misc_feature: HEFZJCU01CPLEG.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggtcaatactatgggggcttgttctggggccaggggaccctggtcatcgtctccccagcctccaccaagggcccatcggtcttcccctggcg

SEQ ID NO: 458630 - DNA, 532 bp, Homo sapiens
  misc_feature: HEFZJCU01BL5PS.12.40.D07.1.454.heavy.3.raw
atacgacgtacacgaccggtgctcgatttagtgatagagcgtaacacagagggctcaccatggagtttgggctgagcgtggtttcgtcgtaggctctttaagaggtgtccagtgtcaggggcacctggtggagtctggggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctgggtcatcgtctccccagcctccaccaagggcccatcggtccttccccctcgggccgccctcg

SEQ ID NO: 458631 - DNA, 488 bp, Homo sapiens
  misc_feature: HEFZJCU01EMOE0.51.27.C05.1.454.heavy.3.raw
cgatcgtatacacgaccggtgctcgatttagacgcgatcgaagggtttggggagctctgggagacgagcccagcactggaagtcgccggtgtttccattcggtgatcatcactgaatacagaggactcaccatggagtttgggctgagctgggttttcctcgttgctcttttaagaggtgtccagtgttatgtgcagctggtggagtctgggggaggcgtggtccagcctgggaggtccctgagactcgcctgtacaccctctggattcaccttcagtaactatgcaatgcactgggtccgccaggctccaggcaaggggctggactgggtggcaggtatatcatatgatggaagcaataaatactacgcagactccgtgaagggccgattcaccatctccagagacagttccgatgacacagtctatctgcaaatgaacagcctgagagctgaggacacggctctttttactgtgcgccaggaagca

SEQ ID NO: 458632 - DNA, 513 bp, Homo sapiens
  misc_feature: HEFZJCU01CBNK8.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttccccctggcgccctgctccaggagcacctctgggggcacagcggccctgggctgcctggtcaaggactacttcccatac

SEQ ID NO: 458633 - DNA, 482 bp, Homo sapiens; identical to SEQ ID NO: 444904
  misc_feature: HEFZJCU01BP2IX.47.59.F04.1.454.heavy.3.raw

SEQ ID NO: 458634 - DNA, 507 bp, Homo sapiens
  misc_feature: HEFZJCU01C6FED.51.43.D10.1.454.heavy.3.raw
cgatcgtatacacgaccggtgctcgatttagactagcagtaagggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccatatatttctgtgcgcgaggaatttcgacttctggaataattacttgggttggaaactaccttcattactggggccagggaaccctggtcaccgtctcctcagcctccaccaagggcccatcggtcttcccctggcaccctcctccaagagcacctctgggggcacagcggcctgggctgcctggtcaaggactacttcctcgtagcact

SEQ ID NO: 458635 - DNA, 517 bp, Homo sapiens
  misc_feature: HEFZJCU01EM92L.14.61.F06.1.454.heavy.3.raw
cgtctagtaccacgaccggtgctcgatttagctacgctctaagggaaaggggacccaaaaaccacacccctccttgggagaatcccctagatcacagctcctcaccatggactggacctggagcatccttttcttggtggcagcagcaacaggtgcccactcccaggttcagctggtgcagtctggagctgaggtgaagatgcctggggcctcagttgaggtctcctgcaggacttctggttacacctttaccaactatggtatcacctgggtgcggcaggtcccaggacaagggcttgagtggctgggatggatcagcggtttcgatgagaaaaccagttctgcacaaaagttccagggcagactcaccctgactacagacgcatcaacgggctcagccttcatgaccctgaggaacctgagacctgacgacgcggccatctattactgtgcgagagatggggtggcagctcgtctcaggaattgacttcgtgggggcccggaacctggatcaccg

SEQ ID NO: 458636 - DNA, 483 bp, Homo sapiens
  misc_feature: HEFZJCU01EDOYS.26.78.H01.1.454.heavy.3.raw
agactatactcacgaccggtgctcgatttagtgtgagtagtttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaattgaagaacacgctgtatctgacaaatgaacagcctgagagctgaagacacggctgttgtttactgtgcgagagagatgacg

SEQ ID NO: 458637 - DNA, 526 bp, Homo sapiens
  misc_feature: HEFZJCU01C2NOG.16.9.A09.1.454.heavy.3.raw
tgtactactccacgaccggtgctcgatttagcgagacgcgcagggggagagaggggcccagccctgggattttcaggtgttttcatttggtgatcaggactgaacagagagaactcaccatggagtttgggctgagctggctttttcttgtggctattttaaaaggtgtccagtgtgaggtgtagttggtggactctgggggagacctgataccgcctggggggtccctgagactctcctgtacagcctctggattcacctttaggagccatgccatgagctgggtccgccaggctccagggaaggggctggagtgggtctctactattactgctagtggtaatcatgcatactatgcagactccgtgaagggccggttcaccttcaccagagacaattccaagaacacgctctatctgcaattgaccagcctgagcgccgaggacacggccatgtattactgtactaaatcgcgggtggccgcggccggtaccgtcggatggtttgtatttctggggccagggac

SEQ ID NO: 458638 - DNA, 483 bp, Homo sapiens
  misc_feature: HEFZJCU01DNBBT.47.59.F04.1.454.heavy.3.raw
agctcacgtacacgaccggtgctcgatttagtacacacacttagggattggggggtccctgagactctcctgtgcagcctctggattcattttcagtagctacagcatgaattgggtccgccgggctccagggagggggcgtggagtggatttcatacattggtgttaggagtaacatcatacactatgcagactctgtgaagggccgattcaccgtttcccgagacgatgccaagaactcactgtatctgcaaatgaacagcctgagagacgaggacacggctatttattattgtgtgagagtaaaggataatgggggctcaaaccaaatttttcactactggggccagggatccctggtcgccgtcggctcagcctccaccaagggcccatcggtcttcccctggcgccctgctccaggagcacctccgagagcacagcggccctgggctgcctggtcaaggactacttcctacgtgagct

SEQ ID NO: 458639 - DNA, 400 bp, Homo sapiens; identical to SEQ ID NO: 444452
  misc_feature: HEFZJCU01DAZM7.47.24.C02.1.454.heavy.3.raw

SEQ ID NO: 458640 - DNA, 545 bp, Homo sapiens
  misc_feature: HEFZJCU01DI5Y6.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatggagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccgaagggacgctggtcaccgtctcttcagcctccaccaacgggcccatcggtccttccccgtcggccaccctcctccaagacgcacctctgggggcacagcc

SEQ ID NO: 458641 - DNA, 518 bp, Homo sapiens; identical to SEQ ID NO: 451347
  misc_feature: HEFZJCU01ERYG6.7.78.H01.1.454.heavy.3.raw

SEQ ID NO: 458642 - DNA, 517 bp, Homo sapiens
  misc_feature: HEFZJCU01CPSAO.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggcgccctgctccaggagcacctccgagagcacagcggccct

SEQ ID NO: 458643 - DNA, 503 bp, Homo sapiens
  misc_feature: HEFZJCU01A4UUP.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacatggagctgagcagcctgacatctgaagacacggctgtgtattactgttcgagacgggctagtctgggatctagttatagtgactcgtcgttctggggtccg

SEQ ID NO: 458644 - DNA, 387 bp, Homo sapiens
  misc_feature: HEFZJCU01AVTVL.11.20.B09.1.454.heavy.3.raw
cgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaagggcccatcggtcttccccctggcaccctcctccaagagcacctctgggggcacagcggccctgggccgcctggtcaaggactacttccgtatctctcg

SEQ ID NO: 458645 - DNA, 506 bp, Homo sapiens
  misc_feature: HEFZJCU01DBE3A.9.34.D01.1.454.heavy.3.raw
  modified_base (465)..(465): a, c, t, g, unknown or other
  modified_base (478)..(478): a, c, t, g, unknown or other
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaaggccatcggtcttcccctggcaccctcctccaagagcactctgggngcacacgcgccgnggctgcctggtacaggactctcagacgt

SEQ ID NO: 458646 - DNA, 495 bp, Homo sapiens; identical to SEQ ID NO: 446642
  misc_feature: HEFZJCU01BX3J5.51.78.H01.1.454.heavy.3.raw

SEQ ID NO: 458647 - DNA, 489 bp, Homo sapiens
  misc_feature: HEFZJCU01DDWPW.40.17.B06.1.454.heavy.3.raw
tctagcgactcacgaccggtgctcgatttagtcgatagtgaagggggcagagcctgctgaattctggctgactagggcagtcaccagagctccagacaatgtctgtctccttcctcatcttcctgcccgtgctgggcctcccatggggtgtcctgtcacaggtacagctgcagcagtcaggtccaggactggtgaagccctcgcagaccctctcactcacctgtgccatctccggggacagtgtctctggtaatagtgttgcttggaactggatcaggcagtccccatggagaggccttgagtggctgggaaggacatcctacaggtccgacaggtccgagtggttaaatgaatttgctagtttttgtggaaagtcgaataaccatcaatgcagacacatccaagaaccagttctccctgcacctaaactctatgactcccgaggacgcggctgtttattactgtgcaagaggacgaattgcatactat

SEQ ID NO: 458648 - DNA, 518 bp, Homo sapiens; identical to SEQ ID NO: 450293
  misc_feature: HEFZJCU01AZRRZ.9.70.G04.1.454.heavy.3.raw

SEQ ID NO: 458649 - DNA, 528 bp, Homo sapiens
  misc_feature: HEFZJCU01DLWQY.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtgaattgactactgggccagggaacctggtcaccgtctcctcagcctccaccaaggg

SEQ ID NO: 458650 - DNA, 501 bp, Homo sapiens; identical to SEQ ID NO: 447719
  misc_feature: HEFZJCU01D9VC9.17.10.A10.1.454.heavy.3.raw

SEQ ID NO: 458651 - DNA, 396 bp, Homo sapiens; identical to SEQ ID NO: 444469
  misc_feature: HEFZJCU01EMLRR.47.46.E02.1.454.heavy.3.raw

SEQ ID NO: 458652 - DNA, 494 bp, Homo sapiens
  misc_feature: HEFZJCU01C1JTX.4.6.A06.1.454.heavy.3.raw
agcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaatccctccctcaagagtcgactcaccatctcggctgacccgtccaagaatcagttctccctgaggctgacctctgtgaccgccgctgacacggccgtctattactgtgggagacagtgcagtggtggttcgtgccccgagtactggggccgcggaatcttggtcaccgtctcctcagcctccaccaagggcccatcggtcttcccctggcgccctcgctccaggagcacctccgacgaggcaccagcggccctcgggctgcctggtcaaggactaacttccctaccagtgc

SEQ ID NO: 458653 - DNA, 504 bp, Homo sapiens
  misc_feature: HEFZJCU01E0MOX.53.5.A05.1.454.heavy.3.raw
cgcgtatacacacgaccggtgctcgatttagatagatagacagggggggagaggagcccagcactagaagtcggcggtgtttccattcggtgatcaccactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcaattatatcatatgatggaagtaagaagtactatgcagacttcctggagggccgattcaccatctccagagacaattccaagaacacgcagtatctccaaatgcacggcctgagagctgacgacacggctgtgtattactgtgcgaaagatcaaggttcggggatccgaaattttaggtaaa

SEQ ID NO: 458654 - DNA, 386 bp, Homo sapiens; identical to SEQ ID NO: 446054
  misc_feature: HEFZJCU01DSCTS.18.60.F05.1.454.heavy.3.raw

SEQ ID NO: 458655 - DNA, 498 bp, Homo sapiens
  misc_feature: HEFZJCU01EM4EO.48.81.H04.1.454.heavy.3.raw
agtatacatacacgaccggtgctcgatttagtagtgtagattcgcggggacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctggagaccgtgacgacacggccatttactactgtgcgcggggaggtggacggagctcgggttttcggagttatcatctact

SEQ ID NO: 458656 - DNA, 500 bp, Homo sapiens
  misc_feature: HEFZJCU01EMUFP.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagtttgttgggcggatagcagcgggtacc

SEQ ID NO: 458657 - DNA, 497 bp, Homo sapiens; identical to SEQ ID NO: 445179
  misc_feature: HEFZJCU01DWGBU.12.55.E11.1.454.heavy.3.raw

SEQ ID NO: 458658 - DNA, 482 bp, Homo sapiens; identical to SEQ ID NO: 445068
  misc_feature: HEFZJCU01CITL6.11.23.C01.1.454.heavy.3.raw

SEQ ID NO: 458659 - DNA, 532 bp, Homo sapiens
  misc_feature: HEFZJCU01D8LS8.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaacctggtcaccgtctcctcacgcctccaccaaggg

SEQ ID NO: 458660 - DNA, 461 bp, Homo sapiens
  misc_feature: HEFZJCU01D76OQ.51.5.A05.1.454.heavy.3.raw
cgatcgtatacacgaccggtgctcgatttagatagatagacaggggaccttcctgccagacaccacctcagcccctcctggaagggacaggagcgcgcaagggtgagtcagaccctcctgccctcgatggcaggtggagaagattcagaaaggtctgagatccccgggacgcagcaccactgtcaatgggggccccagacgcctggaccagggcctgcgtgggaaaggcctctgggcacactcaggggctttttgtgaagggtccgcctactgtgtgactacggtaaatacgttaattcttctactacgatatggacgtctggggccaagggaccacggtcaccgtctcttcagcctccaccaagggcccatcggtcttccccctggcaccctcctccaagagcacctctgggggcacagcgccctgggctgcctggtcaaggactactcctcgtagcact

SEQ ID NO: 458661 - DNA, 372 bp, Homo sapiens; identical to SEQ ID NO: 444513
  misc_feature: HEFZJCU01CK3W1.5.23.C01.1.454.heavy.3.raw

SEQ ID NO: 458662 - DNA, 511 bp, Homo sapiens
  misc_feature: HEFZJCU01C9RFV.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggaggggggaaccgagcgggagtccgaagtactcctttg

SEQ ID NO: 458663 - DNA, 439 bp, Homo sapiens
  misc_feature: HEFZJCU01DZZHT.19.25.C03.1.454.heavy.3.raw
tactctcgtgcacgaccggtgctcgatttagtagtgtagatttgggtttggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttcccacgagagta

SEQ ID NO: 458664 - DNA, 521 bp, Homo sapiens
  misc_feature: HEFZJCU01DKJZU.11.13.B02.1.454.heavy.3.raw
  modified_base (487)..(487): a, c, t, g, unknown or other
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaacgggcccatcggtccttccccctggccgccctgctccaggngcacctccgacgagcacacgcggccctgggctcg

SEQ ID NO: 458665 - DNA, 524 bp, Homo sapiens
  misc_feature: HEFZJCU01A5HL7.48.86.H09.1.454.heavy.3.raw
agtatacatacacgaccggtgctcgatttagtgctatagacttgggtttggggagtgactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctccaagaacgaggttgtcctttccttggccaacatgcaccctgtggacacggccacttatttttgtacacacaccatcttgacgactggggatgcttttcatttctgggcaggggaccgtggtcgccgtgtctacagcctccaccaagggcccatcggtcttccccctc

SEQ ID NO: 458666 - DNA, 528 bp, Homo sapiens
  misc_feature: HEFZJCU01BYMEG.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactactgggggttcgaccccgtgggggccagggaaccctggtcaccgtctcctcagcctccaccg

SEQ ID NO: 458667 - DNA, 499 bp, Homo sapiens
  misc_feature: HEFZJCU01AVLFR.51.78.H01.1.454.heavy.3.raw
cgatcgtatacacgaccggtgctcgatttagtgtgagtagtttgggtttgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtccttccccctggcaccctcctccaagagcacctctgggggcacagcggccctgggctgcctggtcaaggactacttcctcgtagcact

SEQ ID NO: 458668 - DNA, 531 bp, Homo sapiens
  misc_feature: HEFZJCU01DCTYM.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaacgggcccatcggtcttccccctggccgccctgctccaggagcacctccgagacg

SEQ ID NO: 458669 - DNA, 532 bp, Homo sapiens
  misc_feature: HEFZJCU01CJFYF.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcagggacacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaacgggcccatccggtctttccccctggccgccctcg

SEQ ID NO: 458670 - DNA, 464 bp, Homo sapiens
  misc_feature: HEFZJCU01AXHVP.14.68.G02.1.454.heavy.3.raw
cgtctagtaccacgaccggtgctcgatttagtcgatagtgaagggaaagggtgtacacctgtggttctcactcaccgatggtcgattgggtgtgagctggatccgtcagtccccagggaaggccctggagtggcttgcacacatgtattggaatgacgaaaatcgtacaggaaatctctgcagagcaggctcatcatctccagggacacatccaaaagccaggtggtccttaccatgaccaacatggaccctgtggacacagccacatattactgtgcacggatcgtttattattacggttcggggagctccaagcttgactactgggccagggaaccctggtcaccgtctcctcagcctccaccaagggcccatcggtcttccccctggcaccctcctccaagagcacctctggggcacagcggccctgggctgcctggtcaggactacttccgtactagacg

SEQ ID NO: 458671 - DNA, 525 bp, Homo sapiens
  misc_feature: HEFZJCU01C9BWP.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctggggccaggggaccctggtcatcgtctccccagcctccaccagggcccatcggtcttcccctggcgccctcg

SEQ ID NO: 458672 - DNA, 517 bp, Homo sapiens
  misc_feature: HEFZJCU01D5F1W.2.11.A11.1.454.heavy.3.raw
acgctcgacacacgaccggtgctcgatttagctacgactgcagggtgtacacctgtggttctcgggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgaggtgtccttgggttttggggcctcgggggctactggggccagggaaccatggtcaccgtctcctcagcctccaccaagggcccatcggtcttccccctggcaccctcctccaagagcacctctgggggcacagcggccctgggctgcctggtcaaggactacttcctgtcgagcgt

SEQ ID NO: 458673 - DNA, 543 bp, Homo sapiens; identical to SEQ ID NO: 446584
  misc_feature: HEFZJCU01AQW4M.16.39.D06.1.454.heavy.3.raw

SEQ ID NO: 458674 - DNA, 501 bp, Homo sapiens; identical to SEQ ID NO: 447123
  misc_feature: HEFZJCU01AW7PY.3.20.B09.1.454.heavy.3.raw

SEQ ID NO: 458675 - DNA, 483 bp, Homo sapiens
  misc_feature: HEFZJCU01CF0CG.47.85.H08.1.454.heavy.3.raw
  modified_base (480)..(480): a, c, t, g, unknown or other
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccacaaggcccatcggtcttcccctgcgcctgctccaggagcacctcgagagcacagcggcctgggctgcctggtcaaggactacttcctacgtgngct

SEQ ID NO: 458676 - DNA, 534 bp, Homo sapiens
  misc_feature: HEFZJCU01CIGBQ.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagtttacgtggactctgtgaagggccgtttcaccatctccagagacaacgccaagaattcactgtatctacaactgaacagcctgagagtcgcagacacggccgtgtattactgtgcgagatgtaggaaaaagtatggctgtgtttattggggccagggagccctggtcaccg

SEQ ID NO: 458677 - DNA, 535 bp, Homo sapiens
  misc_feature: HEFZJCU01EQE4Z.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgtccgtttattttgtacgtagagcgtcgtctgtcagtggaattgactactggggccagggaaccctggtccaccgtctcctcagcctccaccgaacgg

SEQ ID NO: 458678 - DNA, 523 bp, Homo sapiens
  misc_feature: HEFZJCU01A0DCV.4.35.D02.1.454.heavy.3.raw
agcactgtagcacgaccggtgctcgatttagcacacgatagttgggtttgggggggaaatactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaagggaagggactggagtgggttggatatatctttcacaccgggaccaccaactacaatccctccctcaagagtcgactcaccatgtcactggacacttccaagaaccagttctccctaaaattgacctctgtgagcgctgcagacacggccgtctattactgtgcgagactgcgggggctattatggttcgggagatcccagtggttttgatatatggggccaggggacagcggtcaccgtctcttcag

SEQ ID NO: 458679 - DNA, 505 bp, Homo sapiens; identical to SEQ ID NO: 447540
  misc_feature: HEFZJCU01AM8SW.16.34.D01.1.454.heavy.3.raw

SEQ ID NO: 458680 - DNA, 477 bp, Homo sapiens; identical to SEQ ID NO: 444659
  misc_feature: HEFZJCU01EE3RZ.16.10.A10.1.454.heavy.3.raw

SEQ ID NO: 458681 - DNA, 390 bp, Homo sapiens; identical to SEQ ID NO: 444541
  misc_feature: HEFZJCU01CG8ML.16.24.C02.1.454.heavy.3.raw

SEQ ID NO: 458682 - DNA, 503 bp, Homo sapiens
  misc_feature: HEFZJCU01DY5DQ.12.38.D05.1.454.heavy.3.raw
atacgacgtacacgaccggtgctcgatttagtatctgatagttgggtcgtgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaacgggcccatcggtcttcccctggcgccctgctccaggagcacctccgagagcacagcggcccgtgggctgcctggtcaaggactacttcctacgtcgtat

SEQ ID NO: 458683 - DNA, 489 bp, Homo sapiens
  misc_feature: HEFZJCU01A46TE.51.38.D05.1.454.heavy.3.raw
cgatcgtatacacgaccggtgctcgatttagtatctgatagttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctctttttactgtgcgccaggaagca

SEQ ID NO: 458684 - DNA, 507 bp, Homo sapiens; identical to SEQ ID NO: 450163
  misc_feature: HEFZJCU01EU0YX.16.21.B10.1.454.heavy.3.raw

SEQ ID NO: 458685 - DNA, 487 bp, Homo sapiens
  misc_feature: HEFZJCU01D6HMH.22.86.H09.1.454.heavy.3.raw
acatacgcgtcacgaccggtgctcgatttagtgctatagacttgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgttctccaaatgaacagcctgagaggcgaggacacggcagtgtattactgtgcgagagatcgacatgaacg

SEQ ID NO: 458686 - DNA, 516 bp, Homo sapiens
  misc_feature: HEFZJCU01CQFUE.16.38.D05.1.454.heavy.3.raw
tgtactactccacgaccggtgctcgatttagtatctgatagttgggtttgggctcaactctcttgtctcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagtttttcctatgcactggatccgccaggctccaggcaggggactggagtgggtggcaggagtgtcacttgatggagccaatacatacttcgcagactccgtgaagggccgattcaccatttccagagagaattccaacaacacgctgcatctgcaaatggacaccctgagacctgacgacacggctgtctattactgtgtgagactcttattgcgttcggggctttgactactggggccaggggatccctggtcaccgtctcctcagcctccaccagggccatcggtcttcccctc

SEQ ID NO: 458687 - DNA, 516 bp, Homo sapiens
  misc_feature: HEFZJCU01CFQUD.51.26.C04.1.454.heavy.3.raw
cgatcgtatacacgaccggtgctcgatttagtctagcgactttgggtttggggctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatc

SEQ ID NO: 458688 - DNA, 422 bp, Homo sapiens
  misc_feature: HEFZJCU01AHEP9.16.78.H01.1.454.heavy.3.raw
tgtactactccacgaccggtgctcgatttagtgtgagtagtttgggtttggggcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttcccccctggcaccctcctccaagagcacctctggggcacagcggccctgggctgcctggtcaaggactacttccgagtagtaca

SEQ ID NO: 458689 - DNA, 396 bp, Homo sapiens; identical to SEQ ID NO: 444469
  misc_feature: HEFZJCU01BY5RM.47.46.E02.1.454.heavy.3.raw

SEQ ID NO: 458690 - DNA, 506 bp, Homo sapiens; identical to SEQ ID NO: 444696
  misc_feature: HEFZJCU01AYW6J.16.34.D01.1.454.heavy.3.raw

SEQ ID NO: 458691 - DNA, 530 bp, Homo sapiens
  misc_feature: HEFZJCU01C17N3.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcactttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccg

SEQ ID NO: 458692 - DNA, 530 bp, Homo sapiens
  misc_feature: HEFZJCU01BAZ5M.4.59.F04.1.454.heavy.3.raw
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctccctgaggctgagctctgtgaccgccgcggacacggccgtgtatttctgtgcgagatctttcgattttggagtggtaaccccttggctactggggccagggaaccctggtcaccgtctcttcagcctccaccaagggccctac

SEQ ID NO: 458693 - DNA, 491 bp, Homo sapiens
  misc_feature: HEFZJCU01DSJZA.51.52.E08.1.454.heavy.3.raw
cgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggagcccactcccaggtgcagctggtgcagtctgggactgaggtgaagaagcctggggcctcagtgaaggtctcctgcaagacttctggatacaccttcaccgactactatatgcactgggtgcgacaggcccctggacaagggcttgagtggatgggatggatcgaccctaagaatggtgccacaaactatgcacagacttttcagggctgggtcaccatgaccagcgacacatctagcaacacagtctacatggagttgaccagcctggaccgacacggccgtgtatttttgtgtgagagattttcggacaatccagagacccctgtc

SEQ ID NO: 458694 - DNA, 519 bp, Homo sapiens
  misc_feature: HEFZJCU01B9BZM.5.41.D08.1.454.heavy.3.raw
atcagacacgcacgaccggtgctcgatttagtcacgcgagaaagggaaagggatgatccgccccagcagctacaggtgtccagtcccaggtgcagctggtgcagtctggggctgccgtgaagaagcctgggtcctcggtgacactctcctgcaaggcgtctggagccaccttcaccaactatgctttcaactgggtgcgacgggcccctgggcagggacttgagtggctggggcggatcatccctaccgttgatgtggcaaactatgcacagaagttccagggcagagtcacaattaccgcggacaagtccgcgagcacagcctacatggagctgaacaacctgagatctgaagacacggccgtctattactgtacgacctgcgctacggtgactaccgctctgcttcgggacctatatggtctggacgtcgtgggccaagggagcactgtcaccgtctcctcagcctccaccaacgggcccatccggtccttcccccgtcggccacccctcctacccg

SEQ ID NO: 458695 - DNA, 517 bp, Homo sapiens
  misc_feature: HEFZJCU01EAL9I.10.35.D02.1.454.heavy.3.raw
catagtagtgcacgaccggtgctcgatttagcacacgatagttgggtttggggctgggagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtctgggggaggcttggttaagccgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtagggaaggact

SEQ ID NO: 458696 - DNA, 529 bp, Homo sapiens; identical to SEQ ID NO: 446480
  misc_feature: HEFZJCU01BG3KF.18.33.C11.1.454.heavy.3.raw

SEQ ID NO: 458697 - DNA, 392 bp, Homo sapiens; identical to SEQ ID NO: 444682
  misc_feature: HEFZJCU01C32C4.16.70.G04.1.454.heavy.3.raw

SEQ ID NO: 458698 - DNA, 515 bp, Homo sapiens
  misc_feature: HEFZJCU01EQ5RY.13.76.G10.1.454.heavy.3.raw
tcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccccgagactctcctgtgcagcctctgggttcaccgtcagtcacacctacatgagctgggtccgccaggctccagggaagggctggagtgcgtctcttttatttatagtagtggtagtacatactccgcagactccgtgagggccgattcaccatctccagagacaattccaagaacacgctgttcttcaaatgaacagcctgagagccgatgacacggccgtgtattactgtgcgagagagtggggcccacgaacgttactacgctatggacgtctggggccaaac

SEQ ID NO: 458699 - DNA, 506 bp, Homo sapiens
  misc_feature: HEFZJCU01DXQ0W.52.71.G05.1.454.heavy.3.raw
cgcagtacgacacgaccggtgctcgatttagtgtcgtcgcaagagagagggggagctctgagagaggagcccagccctgggattttcaggtgttttcatttggtgatcaggactgaacagagagaaatcaccatggagtttgggctgagctggctttttcttgtggctattttaaaaggtggccaatgtgaggtgcagctggtggagtctgggggaggcttggtacagcccggggggtccctgagactctcctgtgcagcctctggattcagttttaccagctatgccatggcctgggtccgccaggctccagggaaggggctggagtgggtctcaggtattagtggtagtgctatgaccacattctatgcagactccgtgaagggccggttcaccatttccagagacaattccaagagtaccctgtatctgcaatgaacagcctgagagccgacgacacggccgtatattactgtgcgaagcaattactctatggacattatggg

SEQ ID NO: 458700 - DNA, 511 bp, Homo sapiens
  misc_feature: HEFZJCU01DP86J.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaagggctggagtgggtggccagcatgaacggagatggaagtcaaaagactatgtggactctgtgaagggccgattcaccatctccagagacaacgccaagaactcactgtatctgacaatgaacagcctaagacccgaggacacggctagtgtattactgtgcgagagaccgctacgtggggcccggagcccgtggtcc

SEQ ID NO: 458701 - DNA, 512 bp, Homo sapiens
  misc_feature: HEFZJCU01CM1P3.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttcccctggcgccctgctccaggagcacctctgggggcacgagcggccctgggctgcctggtcaaggactactcccatac

SEQ ID NO: 458702 - DNA, 506 bp, Homo sapiens; identical to SEQ ID NO: 444696
  misc_feature: HEFZJCU01CYMBX.16.34.D01.1.454.heavy.3.raw

SEQ ID NO: 458703 - DNA, 491 bp, Homo sapiens
  misc_feature: HEFZJCU01D1A7R.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctgggctgcctggtcaaggacctacttcccatacctcgta

SEQ ID NO: 458704 - DNA, 524 bp, Homo sapiens; identical to SEQ ID NO: 445902
  misc_feature: HEFZJCU01BIVZR.9.78.H01.1.454.heavy.3.raw

SEQ ID NO: 458705 - DNA, 483 bp, Homo sapiens
  misc_feature: HEFZJCU01EAX8T.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagagggatattgctctgatggtgtctgctattacgtctacggtttgacgtctggggccaagggaccacggtcatcgtctcctcagcctccaccaagggcccatcggtcttccccctggcaccctcctccaagagcacctctgggggcacagcggccctgggctgcctggtcaaggactacttccgtatctctcg

SEQ ID NO: 458706 - DNA, 436 bp, Homo sapiens
  misc_feature: HEFZJCU01EOSZH.51.5.A05.1.454.heavy.3.raw
cgatcgtatacacgaccggtgctcgatttagatagatagacaggggccctcctggaagggacaggagcgcgcaagggtgagtcagaccctcctgccctcgatggcaggtggagaagattcagaaaggtctgagatccccgggacgcagcaccactgtcaatggggggccccagacgcctggaccagggcctgcgtgggaaaggcctctgggcacactcaggggctttttgtgaagggtccgcctactgtgtgactacggtaaatacgttaattcttctactacgatatggacgtctggggccaagggaccacgatcaccgtctcttcagcctccaccaagggcccatcggtcttcccctggcaccctcctccaagagcacctctggggcacagcggccctgggctgcctggtcaaggactacttcctcgtagcact

SEQ ID NO: 458707 - DNA, 434 bp, Homo sapiens
  misc_feature: HEFZJCU01B9EY8.11.39.D06.1.454.heavy.3.raw
cgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttcctggggccaggggaccctggtcaccgtctcctcagcctccaccaagggcccatcggtcttccccctggcaccctcctccaagagcacctctgggggcacagcggccctgggcctgcctggtcaaggactacttccgtatctctcg

SEQ ID NO: 458708 - DNA, 543 bp, Homo sapiens
  misc_feature: HEFZJCU01AKUCD.13.57.F02.1.454.heavy.3.raw
tcacgtactacacgaccggtgctcgatttagctcgatatagttgggtttggggtgggaaatactttctgagactcatggacctcctgcacaagaacatgaaacacctgtggttcttcctcctcctggtggcagctcccagctgggtcctgtcccaggtgcagctgcaggagtcgggcccaggactggtgaagccttcggggaccctgtccctaaattgcgctgtctctggtgactccatcagcggtagtaaatggtggagttgggtccgccagcccccagggaaggggctggagtggattggggaaatctttcatagcgggatcaccaactacaacccgtccctcaagagtcgagtcaccatatctatagacaagtccaagaaccacttctccctgaacgtgagttctgtgaccgccgcggacacggccgtgtattactgtgcgagaggattgtggttttactctggttcaatgagttattatgtctttgactattggggccagggaaccctgggtcaccgtctcctcagcctccaccaaggg

SEQ ID NO: 458709 - DNA, 530 bp, Homo sapiens
  misc_feature: HEFZJCU01B39KX.10.85.H08.1.454.heavy.3.raw
catagtagtgcacgaccggtgctcgatttagtatcactcagtcgcgggggagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgagggggagccgggctatggttcggaccttcgtgggggccaggggaacccctgggtctacccg

SEQ ID NO: 458710 - DNA, 360 bp, Homo sapiens
  misc_feature: HEFZJCU01A8AVW.49.39.D06.1.454.heavy.3.raw
agtcgagagacacgaccggtgctcgatttagtgacatctcgcagttatttcatatgatggaagcgataaatactacgcagactccgtgaagggccgagtcaccatctccagacacaattccaagaacacggtgtttctgctggtgaacagcctgagaactgaggacacggctgtgtattactgtgcggcaggcaacgattactacccgaaggactactggggccagggaaccctggtcaccgtctcctcagcctccaccaagggcccatcggtcttccccctggcaccctcctccaagagcacctctgggggcacagcggccctgggctgcctggtcaaggactacttcctctctcgact

SEQ ID NO: 458711 - DNA, 504 bp, Homo sapiens; identical to SEQ ID NO: 445648
  misc_feature: HEFZJCU01ER1AW.17.25.C03.1.454.heavy.3.raw

SEQ ID NO: 458712 - DNA, 466 bp, Homo sapiens
  misc_feature: HEFZJCU01APKAW.15.2.A02.1.454.heavy.3.raw
tctacgtagccacgaccggtgctcgatttagactcatctacaggggtccctgagactctcttgtgcagcgtctggattcaccttcagaagttggggcatgcactgggtccgccaggctccaggcaaggggctgcaatgggtggcgctaatatgggatgacggaagtaaggaatattatgcagactccgtgaagggccgattcaccatctaccagagacaattccaagaagacgctgtttctgcaaatgaacagcctgagagtcgaggacacggctgtatattattgtgcgcgagaggggttggtagcacggtcactggactactggggccagggaaccctggtcaccgtctcctcagcctccaccaagggcccatcggtcttccccctggcaccctcctccaagagcacctctggggacacagcggccctgggctgcctggtcaaggactacttccgctacgtaga

SEQ ID NO: 458713 - DNA, 497 bp, Homo sapiens
  misc_feature: HEFZJCU01AN2ZU.4.26.C04.1.454.heavy.3.raw
agcactgtagcacgaccggtgctcgatttagtctagcgactttgggtttggggggtccctgagactctcctgtacagactctggattcacctttagcagccatgccatgagctgggtccgccaggctccagggaaggggctggagtgggtctcagcaattagtggaggtggtggtggtggtacatactacgcaaactccgtgaggggccgattcaccatctccagagacaattccaagaacacgttatatctgcaaatgaacagcctgcgagccgacgacacggccgtatattactgtgcgaaatgccttattgcgaccgagcgtagcagtggctggtgcaactggctcgaccctggggccagggaacccatgtcaccgtctcctcagcctccaccaagggcccatcggtcttcccctggcgccctgctccaggagcacctccgagaacacagcggcccgtgggctgcctggtcaaggactacttccctacagtgct

SEQ ID NO: 458714 - DNA, 496 bp, Homo sapiens
  misc_feature: HEFZJCU01E0DR7.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccagagcacctctgggggcacagcggccctgggctgcctggtcaaggactacttcctacgtcgtat

SEQ ID NO: 458715 - DNA, 485 bp, Homo sapiens; identical to SEQ ID NO: 446198
  misc_feature: HEFZJCU01DBBXS.47.55.E11.1.454.heavy.3.raw

SEQ ID NO: 458716 - DNA, 502 bp, Homo sapiens
  misc_feature: HEFZJCU01DZQBM.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggcaccctcctccaagagcacctctgggggcacagcggccctgggctgcctggtcaaggactactcctacgtctat

SEQ ID NO: 458717 - DNA, 534 bp, Homo sapiens
  misc_feature: HEFZJCU01B1RYB.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaaacgtccgaagtcgttatcactttgactcctggggccagggaaccctggtcagcgtctcttcagcctccaccaaggcccatcggtcttcccctcggcaccctcctccaagagcacctctgggggcacagcggccctggctg

SEQ ID NO: 458718 - DNA, 525 bp, Homo sapiens
  misc_feature: HEFZJCU01EN86U.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctgggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaagggcccatcggtcttcccctggccgccctgcctccaggagcacctccg

SEQ ID NO: 458719 - DNA, 486 bp, Homo sapiens; identical to SEQ ID NO: 448316
  misc_feature: HEFZJCU01DNPUP.3.48.E04.1.454.heavy.3.raw

SEQ ID NO: 458720 - DNA, 403 bp, Homo sapiens; identical to SEQ ID NO: 445456
  misc_feature: HEFZJCU01EFJWH.3.72.G06.1.454.heavy.3.raw

SEQ ID NO: 458721 - DNA, 508 bp, Homo sapiens
  misc_feature: HEFZJCU01B4KH8.52.26.C04.1.454.heavy.3.raw
cgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtccctcacctgcactgtctctggtgcctccatcagcggtcatggttacttctggggctggatccgccagcccccagggaaggggctggagtggattggaaatatctattatagtgggagcacctcctactacaacccgtccctcaggagtcgagtcactatatccgtagacacgtccaagaaccagttctccctgaagctgagctctgtgaccgccgcagacacggctgtttattactgtgcgagacatctaagcaataatgtggatacacttatggagttgcattcctggggccaggggaaccctggt

SEQ ID NO: 458722 - DNA, 503 bp, Homo sapiens; identical to SEQ ID NO: 445995
  misc_feature: HEFZJCU01BWV6T.17.25.C03.1.454.heavy.3.raw

SEQ ID NO: 458723 - DNA, 525 bp, Homo sapiens
  misc_feature: HEFZJCU01DFXBB.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctattctgcgcgaggaaaagtcgcattccagagcctgtacgcccgccttggtctcgtcagttggtcaatccgccctccagggggacctttggggtttcgacccctggggccagggaaccctggtcaccgtctcctcagcctccaccaagggcccatcggtcttccccctggccaccctcctccaagagcacctctgggggcacagcc

SEQ ID NO: 458724 - DNA, 496 bp, Homo sapiens
  misc_feature: HEFZJCU01DKW5X.40.81.H04.1.454.heavy.3.raw
tctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaacctaccagaggtggcacaaagtatcgacagaactttcagggcagggtcaccatgacctgggacgcgtccatcagcacagtctacatggatctgagcggactggacctctgacgacacggccatgtattactgtggaagagacgttggtggctaccgcggggctgaccactc

SEQ ID NO: 458725 - DNA, 519 bp, Homo sapiens
  misc_feature: HEFZJCU01B7RL7.26.57.F02.1.454.heavy.3.raw
agactatactcacgaccggtgctcgatttagctcgatatagttgggtttggggctgggagaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccagccgggggggtccctgaaactctcatgtgcaggctctggattcacattcagtgactcggctatatactgggtccgccagtctgccgggaaagggctggagtggcttggccgtattagaaccaaacctgacaagtacgcgacaattatgctgcgtcggtgcaaggcaggttcaccatctccagagatgattcagagaacacggcgtatctgcaaatgaacagcctagaaaaccgaggacacggccgtgtattactgtgccagacatccgtcgtattacgtatttttctgtcggtcc

SEQ ID NO: 458726 - DNA, 496 bp, Homo sapiens
  misc_feature: HEFZJCU01CQA8H.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcggaattggtggcggtgactgctattgactactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 458727 - DNA, 538 bp, Homo sapiens
  misc_feature: HEFZJCU01BBAGU.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttcccctggcaccctcctccaagagcacctctgggggcacgagcc

SEQ ID NO: 458728 - DNA, 514 bp, Homo sapiens
  misc_feature: HEFZJCU01BAWPN.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatacctactttgactactgggggacccg

SEQ ID NO: 458729 - DNA, 461 bp, Homo sapiens; identical to SEQ ID NO: 458150
  misc_feature: HEFZJCU01CIM7K.40.23.C01.1.454.heavy.3.raw

SEQ ID NO: 458730 - DNA, 528 bp, Homo sapiens; identical to SEQ ID NO: 446119
  misc_feature: HEFZJCU01EQ1P7.14.35.D02.1.454.heavy.3.raw

SEQ ID NO: 458731 - DNA, 412 bp, Homo sapiens; identical to SEQ ID NO: 444705
  misc_feature: HEFZJCU01CHT17.51.60.F05.1.454.heavy.3.raw

SEQ ID NO: 458732 - DNA, 506 bp, Homo sapiens; identical to SEQ ID NO: 446520
  misc_feature: HEFZJCU01BSP87.10.38.D05.1.454.heavy.3.raw

SEQ ID NO: 458733 - DNA, 492 bp, Homo sapiens; identical to SEQ ID NO: 444827
  misc_feature: HEFZJCU01ES0BJ.4.28.C06.1.454.heavy.3.raw

SEQ ID NO: 458734 - DNA, 507 bp, Homo sapiens
  misc_feature: HEFZJCU01AIBWV.48.41.D08.1.454.heavy.3.raw
agtatacatacacgaccggtgctcgatttagtcacgcgagaaagggaaaggggggggaggcttggtacagcctggcaggtccctgaaactctcctgtgtagcctctggattcaggttgggcgattatgccatgcaatgggtccggcaaggtccagggaagggcctggagtgggtctcaggcatcgattggaaaagcgagaagattgactatgcggagtctgtgaaggggcgattcatcatctccagagacaacgccaagaactccctgtatttgcagatgaacaatctgagacctgacgacacggccttgtattattgtgcaaaagttgtggagtcacagtctctggactacggtatggacgtctggggccaagggaccacggtcacagtctcctcagcctccaccaagggcccatcggtcttccccctggcaccctcctccaagagcacctctgggggcacagcggccctgggctgcctggtcaaggactacttcctatgtatact

SEQ ID NO: 458735 - DNA, 324 bp, Homo sapiens; identical to SEQ ID NO: 444475
  misc_feature: HEFZJCU01DFNL5.18.17.B06.1.454.heavy.3.raw

SEQ ID NO: 458736 - DNA, 497 bp, Homo sapiens
  misc_feature: HEFZJCU01CPP9G.14.55.E11.1.454.heavy.3.raw
cgtctagtaccacgaccggtgctcgatttagcactcgcacgttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacacatgttgatctgcaaatgaatagcctgagagccgaggacacggctgtgtattactgtgtcagagatggaggggtggtgatcca

SEQ ID NO: 458737 - DNA, 506 bp, Homo sapiens
  misc_feature: HEFZJCU01EM95L.18.50.E06.1.454.heavy.3.raw
tacgagtatgcacgaccggtgctcgatttagatctactgacaacacacaaggggctgggagaggagcccagcactgggattccgaggtgtttccattcggtgatcagcactgaacacagaggactcaccatggagttttggctgagctggattttccttgttgctatttcaaaaggtgtccactgtgaggagcagttggtggagactggaggaagcctgatccagccgggggggtccctgagactgtcctgtgtagtctctgggttcagcgtcagtcgcgaccacatgagttggttccgccaggctccagggaagggctggagtggctcgcacttatttacagtggcggcactacatactacacagacttcgcgaggggccgattcaccatctccagagacgattccaagaacacgttgtatcttcaaatgaacagcctgacagtcgacgacacggccatgttattttgtgcgagcgacccggggctcctcatggctttcattacg

SEQ ID NO: 458738 - DNA, 524 bp, Homo sapiens
  misc_feature: HEFZJCU01B0KKW.16.27.C05.1.454.heavy.3.raw
  modified_base (517)..(517): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcgttgagactctcctgtgaaggctctggattcacattcagtgactatggcatacactgggtccgccaggctccaggcaaggggctgaagtgggtgcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactggggccggggagccccggtnatcgtct

SEQ ID NO: 458739 - DNA, 492 bp, Homo sapiens
  misc_feature: HEFZJCU01D4ID9.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgtcatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaagggcccatcggtcttccccctggcaccctcctccaagagcacctctgggggcacagcggccctgggctgcctggtcaaggactacttccgtatctctcg

SEQ ID NO: 458740 - DNA, 504 bp, Homo sapiens
  misc_feature: HEFZJCU01ELO71.10.12.B01.1.454.heavy.3.raw
catagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtccagccagggaggtccctgagactctcctgtgcagcctctggattgaggttcaataactatgctatgcactgggtccgccaggctccagggaaggggctggaatggatgacagttatttcacacgatgcaaccaaaacatactacgcggagttcgtgaggggccgctgcatcgtctccagagacaattcgaagaacactctgtacctgcaaatgaacagtctgagagccgaggacacggccgtctacttttgtgcgactagaagtgggagctataggggattt

SEQ ID NO: 458741 - DNA, 491 bp, Homo sapiens; identical to SEQ ID NO: 447127
  misc_feature: HEFZJCU01DY5C0.12.75.G09.1.454.heavy.3.raw

SEQ ID NO: 458742 - DNA, 477 bp, Homo sapiens
  misc_feature: HEFZJCU01DHK0I.19.71.G05.1.454.heavy.3.raw
tactctcgtgcacgaccggtgctcgatttagtgtcgtcgcaagagagaggggggcagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagacggcccc

SEQ ID NO: 458743 - DNA, 500 bp, Homo sapiens
  misc_feature: HEFZJCU01C4F4K.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactactcctatgtatact

SEQ ID NO: 458744 - DNA, 503 bp, Homo sapiens
  misc_feature: HEFZJCU01BWYUW.51.43.D10.1.454.heavy.3.raw
  modified_base (454)..(454): a, c, t, g, unknown or other
cgatcgtatacacgaccggtgctcgatttagactagcagtaagggggagcatcacccagcaaccacatctgtcctctagagaatcccctgagagctccgttcctcaccatggactggacctggaggatcctcttcttggtggcagcagccacaggagcccactcccaggtgcagctggtgcagtccgggggtgaagtgaagaagcctggggcctcagtgaaggtctcctgcagggcctctggatacaccttcaccggctattatatccactgggtgcgacaggcccctggacaagggcttgagtggatgggatggatgaagcccaatagtggtgccacaaagacagcacagaagtttcagggcagggtcaccatgaccagggagacgtccgtcaggacagcctatatggaggtgaccagcctgagccctgacgacacggccatatatttctgtncgcgaggaatttcgacttctggaataattacttgggttgaaactacctt

SEQ ID NO: 458745 - DNA, 486 bp, Homo sapiens; identical to SEQ ID NO: 444861
  misc_feature: HEFZJCU01C8GIR.47.55.E11.1.454.heavy.3.raw

SEQ ID NO: 458746 - DNA, 511 bp, Homo sapiens
  misc_feature: HEFZJCU01EPT7F.13.71.G05.1.454.heavy.3.raw
tcacgtactacacgaccggtgctcgatttagtgtcgtcgcaagagagaggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtctgggg

SEQ ID NO: 458747 - DNA, 529 bp, Homo sapiens; identical to SEQ ID NO: 446480
  misc_feature: HEFZJCU01D8S0U.18.33.C11.1.454.heavy.3.raw

SEQ ID NO: 458748 - DNA, 393 bp, Homo sapiens
  misc_feature: HEFZJCU01DNADQ.49.58.F03.1.454.heavy.3.raw
agtcgagagacacgaccggtgctcgatttagtctgatcgagaagggaaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttcccctggcaccctcctccaagagcacctctgggggcacagcggccctgggctgcctggtcaaggactacttcctctctcgact

SEQ ID NO: 458749 - DNA, 518 bp, Homo sapiens
  misc_feature: HEFZJCU01BMCN9.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaagggccccatcc

SEQ ID NO: 458750 - DNA, 544 bp, Homo sapiens
  misc_feature: HEFZJCU01BHUCB.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggcttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaaggatcgccctataatggtgctggagtcggggtagtttgggttccgtgggggccaggggaaccctggtccg

SEQ ID NO: 458751 - DNA, 490 bp, Homo sapiens
  misc_feature: HEFZJCU01CGOTQ.10.71.G05.1.454.heavy.3.raw
  modified_base (466)..(466): a, c, t, g, unknown or other
  modified_base (482)..(482): a, c, t, g, unknown or other
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacaagtaaatatactatggagactccttcaagggccgattcaccatctccagagacaattccaagaacatggtgtatctgcaaatgaccagcctgagagccgaggacacgggtntttattactgtggganaaatccta

SEQ ID NO: 458752 - DNA, 490 bp, Homo sapiens; identical to SEQ ID NO: 446400
  misc_feature: HEFZJCU01ARMKE.3.34.D01.1.454.heavy.3.raw

SEQ ID NO: 458753 - DNA, 523 bp, Homo sapiens
  misc_feature: HEFZJCU01BR7C0.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcacctggttctacttcgatctctgggccgtc

SEQ ID NO: 458754 - DNA, 486 bp, Homo sapiens
  misc_feature: HEFZJCU01BVG6G.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaggcccatcggtcttcccctggcgcctgctccagagcacctccgagagcacagcggcccgtgggctgcctggtcaaggactacttcctacgtgagct

SEQ ID NO: 458755 - DNA, 483 bp, Homo sapiens; identical to SEQ ID NO: 453752
  misc_feature: HEFZJCU01BK03E.19.53.E09.1.454.heavy.3.raw

SEQ ID NO: 458756 - DNA, 480 bp, Homo sapiens; identical to SEQ ID NO: 444657
  misc_feature: HEFZJCU01AYF0C.19.67.G01.1.454.heavy.3.raw

SEQ ID NO: 458757 - DNA, 497 bp, Homo sapiens; identical to SEQ ID NO: 445179
  misc_feature: HEFZJCU01AJF1J.12.55.E11.1.454.heavy.3.raw

SEQ ID NO: 458758 - DNA, 533 bp, Homo sapiens
  misc_feature: HEFZJCU01B592K.9.30.C08.1.454.heavy.3.raw
tgatacgtctcacgaccggtgctcgatttagtctgacgtcaaagggaaagggtctgtgaaggcttcaccagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtgactccatcaccggtactaattactactggagttggatccgccagccccccgggaagggcctggagtggattggatacgccttttacagtggagtcacctactacaacccgtccctcaagagccgagttaccatatctgtcgacacgtcccagaatcagttctccctggaggtgacctctgtgactgccgcagactcggccgtgtatttctgtgccagaacgcaaagcagcgcctactatactttaaactttgacttctggggccgaggactccgtgtcctaccgtctcctcacgtcctacccg

SEQ ID NO: 458759 - DNA, 500 bp, Homo sapiens
  misc_feature: HEFZJCU01DC6LM.4.19.B08.1.454.heavy.3.raw
agcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggaggcgtggtccagcctgggaggtccctgagactctcctgtatagcctctggattcaccttcggcagttatgctatgcactgggtccgtcaggctccaggcaaggggttggagtgggtggcagcaatatcatatgatggaagtgataaatattacatagagtccgtgaagggtcgattcaccatctccagagacaatcgacaagaacacactgtatctggaaatgaccagcctgagaggtgacgacacgggtgttttattactgtgcgcgggatagaggctcatcgtggatacaactt

SEQ ID NO: 458760 - DNA, 502 bp, Homo sapiens; identical to SEQ ID NO: 448968
  misc_feature: HEFZJCU01DJE5V.17.10.A10.1.454.heavy.3.raw
  modified_base (460)..(460): a, c, t, g, unknown or other

SEQ ID NO: 458761 - DNA, 495 bp, Homo sapiens; identical to SEQ ID NO: 445611
  misc_feature: HEFZJCU01DVNM3.53.25.C03.1.454.heavy.3.raw

SEQ ID NO: 458762 - DNA, 498 bp, Homo sapiens
  misc_feature: HEFZJCU01DFT69.14.25.C03.1.454.heavy.3.raw
cgtctagtaccacgaccggtgctcgatttagtagtgtagatttgggtttgggggggagacgagcccagcactggaagtcgccggtgtttccattcggtgatcagcactgaacacagaggactcaccatggagtttgggctgagcgtggtttcgtcgttaggctctttaagtaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctggtgtattactgtgggagagatggaggtcgatattgta

SEQ ID NO: 458763 - DNA, 517 bp, Homo sapiens; identical to SEQ ID NO: 446608
  misc_feature: HEFZJCU01DOW3S.9.34.D01.1.454.heavy.3.raw

SEQ ID NO: 458764 - DNA, 527 bp, Homo sapiens
  misc_feature: HEFZJCU01EYFDW.14.55.E11.1.454.heavy.3.raw
cgtctagtaccacgaccggtgctcgatttagcactcgcacgttgggtttggggggaagaggaagactgacggtccccccaggagttcaggtccctgacactctcctgtgcaacgtctggattcagcttcagtagttatggcatgcactgggtccgccaggctccaggcaaggggctggagtgggtggcagttgtgtggtatgacggaagtaatagaaagtatgccgacgccgtgaagggccgattcaccatctccagagacaattccaacaacatgttgtatctgcaaatgaatagcctgagagccgaggacacggctgtgtattactgtgtcagagatggagggggtggtgatccaggtatgattgtgtactactaccacggtctggacgtctggggccaagggaccacggtcaccgtctcctcagcctccaccaagggcccatcggtcttcccctggcaccctcctccaagagcacctctgggggcacagcggccctgggctgcctggtcaaggactacttaccg

SEQ ID NO: 458765 - DNA, 339 bp, Homo sapiens; identical to SEQ ID NO: 444436
  misc_feature: HEFZJCU01CSD8S.47.38.D05.1.454.heavy.3.raw

SEQ ID NO: 458766 - DNA, 503 bp, Homo sapiens
  misc_feature: HEFZJCU01AR8QG.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggtcgctggacaacgacctgagtggatgggatgggcgaaccctaacactggtgtcacagtgtcttcacccatcctccgggatagacttaccatgaccacgaactcctccataaacacagcctacatggagttgaggagcctgacatctgacgacacggccgtctattactgtgcgagagtcccacgatccggtgagcctacggcagcggcctttgacttctc

SEQ ID NO: 458767 - DNA, 509 bp, Homo sapiens
  misc_feature: HEFZJCU01CLIXA.48.86.H09.1.454.heavy.3.raw
  modified_base (457)..(457): a, c, t, g, unknown or other
agtatacatacacgaccggtgctcgatttagtgctatagacttgggtttggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgntatgtggggccaagggacaatggtcaccgtctcttcagcctccaccaacggg

SEQ ID NO: 458768 - DNA, 509 bp, Homo sapiens
  misc_feature: HEFZJCU01DCWJ0.48.86.H09.1.454.heavy.3.raw
agtatacatacacgaccggtgctcgatttagtgctatagacttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttacatggttcggggagtcctccgacccagcaactggttaccg

SEQ ID NO: 458769 - DNA, 506 bp, Homo sapiens
  misc_feature: HEFZJCU01BR7CK.21.35.D02.1.454.heavy.3.raw
tcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctgaaagaagaggacacggctgtatataactgtgcgcgaggaccttattattatggttcaggggaccattgactactggggccagggaaccctggtcaccgtctcctcagcctccaccg

SEQ ID NO: 458770 - DNA, 514 bp, Homo sapiens
  misc_feature: HEFZJCU01AZYXD.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaactcctactacgtctggacgtctgtggccagggaccg

SEQ ID NO: 458771 - DNA, 532 bp, Homo sapiens
  misc_feature: HEFZJCU01DAD5I.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagagggggagtacagtggcagctccaagtactactttgacttctggggccgagggaaccctggtcaccgtctcctcagcctccaccaagggcccatcggtcttccccctcggcgccctgctccaggagcacctccgacgacg

SEQ ID NO: 458772 - DNA, 546 bp, Homo sapiens
  misc_feature: HEFZJCU01C3Q27.12.85.H08.1.454.heavy.3.raw
atacgacgtacacgaccggtgctcgatttagtatcactcagtcgcgggaggtctgagagaggagcccagccccgggattttcaggtgtcctcatttggtgatcaggactgaacagagagaactcaccatggagtttgggctgagctggctttttcttgtggcttttttaaaaggtgcccagtgtgaggtgcaactgttggagtctgggggaggcttggtacagccgggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattacctgtgcgaaggatcgccctataatggtggctggatcggggagtttggttcctggggccagggaaccctggtctaccg

SEQ ID NO: 458773 - DNA, 517 bp, Homo sapiens
  misc_feature: HEFZJCU01B5KJ5.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagtcgacgacacggccgtttatactgtgcgagagattcgagtggttcggggacctcaccctggttctacttcgatctct

SEQ ID NO: 458774 - DNA, 522 bp, Homo sapiens
  misc_feature: HEFZJCU01ARR49.12.40.D07.1.454.heavy.3.raw
  modified_base (487)..(487): a, c, t, g, unknown or other
atacgacgtacacgaccggtgctcgatttagtgatagagcgtaacaacagagggctcaccatggagtttgggctgagcgtgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccngcctccaccaagggcccatcggtcttcccctggcg

SEQ ID NO: 458775 - DNA, 511 bp, Homo sapiens; identical to SEQ ID NO: 445268
  misc_feature: HEFZJCU01D3R0V.48.34.D01.1.454.heavy.3.raw

SEQ ID NO: 458776 - DNA, 502 bp, Homo sapiens
  misc_feature: HEFZJCU01ERW9D.51.71.G05.1.454.heavy.3.raw
cgatcgtatacacgaccggtgctcgatttagtgtcgtcgcaagagagagggggcgtgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagcccg

SEQ ID NO: 458777 - DNA, 476 bp, Homo sapiens
  misc_feature: HEFZJCU01B61O4.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacagcggccctgggctgcctggtcaaggactacttccgagtagtaca

SEQ ID NO: 458778 - DNA, 522 bp, Homo sapiens
  misc_feature: HEFZJCU01BNDM7.13.33.C11.1.454.heavy.3.raw
tcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggcaaatatggttcaggggagttcgactactggggccagggaaccctggtcaccgtctcctcagcctccaccaaggg

SEQ ID NO: 458779 - DNA, 521 bp, Homo sapiens
  misc_feature: HEFZJCU01DGKZT.7.78.H01.1.454.heavy.3.raw
  modified_base (461)..(461): a, c, t, g, unknown or other
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagggancacctctgggggcacagcggccctgggctgcctggtcaaggactacttcctagagacacg

SEQ ID NO: 458780 - DNA, 491 bp, Homo sapiens
  misc_feature: HEFZJCU01E1CZ1.19.53.E09.1.454.heavy.3.raw
tactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaagggccgattcaccatctccagagacaacgccaagaactccctgtatctgcaaatgaacagtctgagagctggaggacacggccttgtatttactgtgcaaggaggtat

SEQ ID NO: 458781 - DNA, 508 bp, Homo sapiens
  misc_feature: HEFZJCU01A2EC6.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggagggggaacgagcgggagtccaagtactccttt

SEQ ID NO: 458782 - DNA, 516 bp, Homo sapiens
  misc_feature: HEFZJCU01A8CTZ.48.35.D02.1.454.heavy.3.raw
agtatacatacacgaccggtgctcgatttagcacacgatagttgggtttggggagtgactcctgtgccccaccatggacacactttgctccacgctcctgctgctgaccatcccttcatgggtcttgtcccagatcaccttgaaggagtctgggccaacgctggtgaaacccacacagaccctcacgctgacctgcaccttctctgggttctcactcaccactgatgaggtgggtgtggcctggatccgtcagcccccgggaaaggccccggagtggcttggattgatttatggggatggtgacaagcgttacagtgcatctctgaagaccagactctccatcaccaaggacacctcaagacgaggttgtcctttcctggccaacatgcaccctgtggacacggccacttatttttgtacacacaccatcttgacgactggggatgcttttcatttctggggccaggggaccgtggtcgccgtgtctacagcctccaccaagggcccatcggtctt

SEQ ID NO: 458783 - DNA, 510 bp, Homo sapiens
  misc_feature: HEFZJCU01DVYES.4.58.F03.1.454.heavy.3.raw
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagtctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagaagtcaccattaccagggacacatccgcgaacacagcctacatggagctgagcagcctgacatctgaagacaacggctgtgtattactgtttcgaggagggctagtctgggatctagtttatagtgtactcgttcgttctggggtaccc

SEQ ID NO: 458784 - DNA, 518 bp, Homo sapiens
  misc_feature: HEFZJCU01CK0UE.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatggggagtggggctggataccggtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaagggcccc

SEQ ID NO: 458785 - DNA, 467 bp, Homo sapiens
  misc_feature: HEFZJCU01DEEET.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggacaatggtcaccgtctcttcagcctccaccaagggcccatcggtcttcccctgcgccctgctccagagcacctccgagagcacagcggcctgggctgcctggtcaaggactacttccctacagtgct

SEQ ID NO: 458786 - DNA, 531 bp, Homo sapiens; identical to SEQ ID NO: 450714
  misc_feature: HEFZJCU01BH17I.21.78.H01.1.454.heavy.3.raw

SEQ ID NO: 458787 - DNA, 539 bp, Homo sapiens
  misc_feature: HEFZJCU01CX848.49.34.D01.1.454.heavy.3.raw
agtcgagagacacgaccggtgctcgatttagatcgtctgtgttgggttttcctcgttgctcttttaagaggtgtccagtgtcaggtgcagctggtggagtctgggggaggcgtggtccagcctgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaaccccgtccgcacggtacggacgtctgggccaagggaccacggtcaccgtctcctcagcctccaccaagggcccactcggtccttccccctcggtccacccctccctccaacgagcacctcctgggggcacagccggccctc

SEQ ID NO: 458788 - DNA, 504 bp, Homo sapiens
  misc_feature: HEFZJCU01DBMPF.51.71.G05.1.454.heavy.3.raw
cgatcgtatacacgaccggtgctcgatttagtgtcgtcgcaagagagagggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaagggcccatcggtcttccccctggcaccctcctccaagagcacctctgggggcacagcggccctgggctgcctggtcaaggactactt

SEQ ID NO: 458789 - DNA, 514 bp, Homo sapiens
  misc_feature: HEFZJCU01BG1V5.49.37.D04.1.454.heavy.3.raw
agtcgagagacacgaccggtgctcgatttagtagcatactgttgggtttggggtgggaaaggagccccagccctgagattcccaggtgtttccattcggtgatcagcactgaacacagaactcaccatggagtttgggctgagcgtggttttccgttgttaggctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctggagtgggtctctcttattaattgggatggtggtatcacctactatgcagactctgtgaagggtcgattcaccatctccagagacaacagcagaaactccctgtatctgcaaatgaacagtctcagaggtgaggacaccgccttctactactgtgcaaaagattacggtgaccacacctattttgaccactgcc

SEQ ID NO: 458790 - DNA, 488 bp, Homo sapiens
  misc_feature: HEFZJCU01B351X.49.41.D08.1.454.heavy.3.raw
agtcgagagacacgaccggtgctcgatttagtcacgcgagaaagggaaaggggtctgggagaggagcccagcactagaagtcggcggtgcttccattcggtgatcagcactgaacacagaggactcaccatggaatttgggctgagctgggttttcctcgttgctcttttaagaggtgtccagtgtcaggtgcagctggtggagtctgggggaggcgtggtccagcctgggaggtccctgagactctcttgtgctgcctctggattcaccttcagggtctatgacatgcactgggtccgccaggctccaggcaaggggctggagtgggtggcatttatatcatatgatggaagcaagatatactatgtagactccgtgaagggccgattcatcatctccagagacaactccgagaacacgctgtatctgcaaatgaacaggctgagagctgaagacacggctttatattactgtgcgaacttaatcac

SEQ ID NO: 458791 - DNA, 526 bp, Homo sapiens
  misc_feature: HEFZJCU01D991D.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcgccctgctccaggacgccgacctccgagagccacacgccggccc

SEQ ID NO: 458792 - DNA, 521 bp, Homo sapiens
  misc_feature: HEFZJCU01AZ6PV.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggttttggggcgcggactcctcttgagatctggggccaggggacaatggtcaccgtctctttcag

SEQ ID NO: 458793 - DNA, 522 bp, Homo sapiens
  misc_feature: HEFZJCU01CTRON.47.53.E09.1.454.heavy.3.raw
agctcacgtacacgaccggtgctcgatttagagagagtgtgttgggtttgggggactcctgtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttccaaaaaccaagtggtcctgacaatgaccaacgtgaagcctgcggacacggccacatattattgtgcacaccgacgctataccgccagctgggaaatcgacaactggttcgacccctggggccaggggaacccttgtcaccgtctcctcagcctcccaccaacgggcccacg

SEQ ID NO: 458794 - DNA, 508 bp, Homo sapiens
  misc_feature: HEFZJCU01CTB63.10.28.C06.1.454.heavy.3.raw
catagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactgggtccgccaggctccagggaagggctggagtgggtttcatatattgatagaaatagtggaaccatatactatgcagactctgtggaggggccggattcaccatctccggagacaatgccaggaattcactgtatgtggaaatgaacagtctgagagccgaggacacggctctctattactgtgcgagagccccgaaaatagggtactacgta

SEQ ID NO: 458795 - DNA, 389 bp, Homo sapiens; identical to SEQ ID NO: 451907
  misc_feature: HEFZJCU01AHE86.52.34.D01.1.454.heavy.3.raw

SEQ ID NO: 458796 - DNA, 507 bp, Homo sapiens
  misc_feature: HEFZJCU01C1255.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggatccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctgaaatgaacaatctgagagtcgacgatacggctgtctatcattgtgttttcgatgccttcggtccgcgggacttctgggccagggaaccct

SEQ ID NO: 458797 - DNA, 529 bp, Homo sapiens
  misc_feature: HEFZJCU01AU3IP.49.27.C05.1.454.heavy.3.raw
agtcgagagacacgaccggtgctcgatttagacgcgatcgaagggtttgggggggagaggagcccagcactagaagtcggcggtgcttccattcggtgatcagcactgaacacagaggactcaccatggagtttgggctgagctgggttttccttgttgctattttaaaaggtgtccagtgtgaagggcagctggtggagtccgggggaggcttggttcagcctggggggtccctaagactctcctgtgcagcctctggaatcgccttcaataagtttggatgtactgggtccgccaagttccagggaagggctgatgtgggtctcacgtattgatgttgatggggagttacagtgaccacgcggactctgtggaagggccgattcaccgtctccagacgaaaacgccaagaacacggtgtatctgcaaatgactggcctgagagccgaggacacggcagtttattactgtgcaagaggcttgtggtcgactgtcgacctggactggtactcgatctgtggggccgtgg

SEQ ID NO: 458798 - DNA, 490 bp, Homo sapiens
  misc_feature: HEFZJCU01B15T3.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacagt

SEQ ID NO: 458799 - DNA, 465 bp, Homo sapiens; identical to SEQ ID NO: 444805
  misc_feature: HEFZJCU01AI2YR.19.10.A10.1.454.heavy.3.raw

SEQ ID NO: 458800 - DNA, 514 bp, Homo sapiens
  misc_feature: HEFZJCU01DM7Q2.17.33.C11.1.454.heavy.3.raw
  modified_base (490)..(490): a, c, t, g, unknown or other
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtntccgcagcctccaccaagggcccc

SEQ ID NO: 458801 - DNA, 379 bp, Homo sapiens; identical to SEQ ID NO: 444646
  misc_feature: HEFZJCU01CGC6I.9.11.A11.1.454.heavy.3.raw

SEQ ID NO: 458802 - DNA, 504 bp, Homo sapiens; identical to SEQ ID NO: 445648
  misc_feature: HEFZJCU01ER3KM.17.25.C03.1.454.heavy.3.raw

SEQ ID NO: 458803 - DNA, 523 bp, Homo sapiens
  misc_feature: HEFZJCU01C6FAI.10.85.H08.1.454.heavy.3.raw
catagtagtgcacgaccggtgctcgatttagtatcactcagtcgcgggggagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgagggggagccggctatggttcggacctcgtggggccagggaaccctggtctaccg

SEQ ID NO: 458804 - DNA, 432 bp, Homo sapiens; identical to SEQ ID NO: 445970
  misc_feature: HEFZJCU01B060L.53.65.F10.1.454.heavy.3.raw

SEQ ID NO: 458805 - DNA, 361 bp, Homo sapiens; identical to SEQ ID NO: 446165
  misc_feature: HEFZJCU01C6RR0.16.17.B06.1.454.heavy.3.raw

SEQ ID NO: 458806 - DNA, 502 bp, Homo sapiens; identical to SEQ ID NO: 451675
  misc_feature: HEFZJCU01EFA51.51.78.H01.1.454.heavy.3.raw

SEQ ID NO: 458807 - DNA, 513 bp, Homo sapiens
  misc_feature: HEFZJCU01BD9AM.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacacagactccgtgaagggccggttcaccatctccagagacaattccaagaacacactgtatctgcaaatgaacagcctgagagccgacgacacggccatatattactgtgcgaaagcaccggcagttagtcacccatacttactttgaactctggggccg

SEQ ID NO: 458808 - DNA, 467 bp, Homo sapiens; identical to SEQ ID NO: 445159
  misc_feature: HEFZJCU01D264I.48.7.A07.1.454.heavy.3.raw

SEQ ID NO: 458809 - DNA, 519 bp, Homo sapiens
  misc_feature: HEFZJCU01C968Y.49.11.A11.1.454.heavy.3.raw
  modified_base (450)..(450): a, c, t, g, unknown or other
agtcgagagacacgaccggtgctcgatttagctacgactgcagggggggagaggagccccagccttgggattcccaagtgttttcattcagtgatcaggactgaacacagaggactcaccatggagtttgggctgacctggattttccttgctgctattttaaaaggtgtccagtgtcaggtccagctggtggagtctgggggaggcttggtaaggcctggggggtcccttagactctcctgtgcagcctctggattcaatttcaatgacgcctggatgagctgggtccgacaggctccagggaaggggctggagtgggttgcccgtattaaaagcagagttgatgggtgggacaagagagtacgctgcgaccgtgaaaggcagagtcagcatctcaagagatgattcaagagacacggtgtttctgcaattgaccagcctgaaaacggnggacacagccgtgtattactgtgccacgtggcaccatggatacgcctattcttacaaagagggacttcg

SEQ ID NO: 458810 - DNA, 517 bp, Homo sapiens
  misc_feature: HEFZJCU01BQ8OA.51.26.C04.1.454.heavy.3.raw
cgatcgtatacacgaccggtgctcgatttagtctagcgactttgggtttggggtctgggagacgagcccagcactggaagtcgccggtgtttccattcggtgatcatcactgaacacagacatggagtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatc

SEQ ID NO: 458811 - DNA, 526 bp, Homo sapiens
  misc_feature: HEFZJCU01BAOA8.8.10.A10.1.454.heavy.3.raw
ctcgcgtgtccacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggcccctggacaagggcttgagtggattggatggatcagcgcttacaatggtaagacatacacaaactatgcacagaagttccagggcagagtctccatgaccatagacacatccgcgaccacagcctatatggagttgacgagcctgagatctgacgacacggccgtgtattactgtgcgagggatgtagtagtgacgtggtacgccggggggaaacttgactactggggccagggatccctggtcaccgtctcctcagcctccaccaagggcccatcggtcttccccctggcaccctcctccaagagcacctctgggggcacagcggccctgggctgcctggtcaaggactacttccgacacgcg

SEQ ID NO: 458812 - DNA, 526 bp, Homo sapiens
  misc_feature: HEFZJCU01CKJ4X.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggcgtacgacttgacttttggggccagggaaacctggtcaccgtctccccagcttccaccaagggcccatcggtcttccccg

SEQ ID NO: 458813 - DNA, 387 bp, Homo sapiens; identical to SEQ ID NO: 444635
  misc_feature: HEFZJCU01EDCTQ.11.27.C05.1.454.heavy.3.raw

SEQ ID NO: 458814 - DNA, 492 bp, Homo sapiens
  misc_feature: HEFZJCU01ELSUY.19.1.A01.1.454.heavy.3.raw
tactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaagggcttgagtggatgggaggaagcatccctttctttgatactccagactacgcacagaagttccagggcagagtcacgattaccgcggacgaatccacgagcacagtctatatggaattgaccagcctgacatcagaggacacggccgtctatttttgtgtcgacagaaagagattccatactcaggcggggcactatggcagcagctg

SEQ ID NO: 458815 - DNA, 498 bp, Homo sapiens
  misc_feature: HEFZJCU01EP3HP.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtctgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgt

SEQ ID NO: 458816 - DNA, 480 bp, Homo sapiens
  misc_feature: HEFZJCU01ALNFY.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggactactcctagagacacg

SEQ ID NO: 458817 - DNA, 497 bp, Homo sapiens
  misc_feature: HEFZJCU01CBZIM.53.4.A04.1.454.heavy.3.raw
cgcgtatacacacgaccggtgctcgatttagagtagtgatcaggggctgggagacgagcccagcactggaagtcgccggtgtttccattcggtgatcatcactgaacacagaggactcaccatggagtttgggctgagctgggttttcctcgttgctgttttaagaggtgtccagtgtcaggtgcatctggtggagtctgggggaggcgtggtccagcctggggggtccctgagactctcctgtgcagcctctggattcaccttcagtacctatcctattcactgggtccgccaggctccaggcaagggcctggagtgggtggcacttatatcatatgatggaggtgataaatactacgcagactccgtgaagggccgattcgccatctccagagacaattccaagaacaccctctatctacaaatgaagagactgagacctgaggacacggctgtctattactgtgcgagagtcggctttagagatgcctacaaga

SEQ ID NO: 458818 - DNA, 512 bp, Homo sapiens; identical to SEQ ID NO: 447732
  misc_feature: HEFZJCU01D94VC.4.25.C03.1.454.heavy.3.raw

SEQ ID NO: 458819 - DNA, 497 bp, Homo sapiens
  misc_feature: HEFZJCU01DJGJH.40.37.D04.1.454.heavy.3.raw
tctagcgactcacgaccggtgctcgatttagtagcatactgttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactgggggccgggaatcctggtcaccgtctcctcagcctccaccaagggcccatcggtcttcccctggcgccctgctccaggagcacctccgagagcacagcggccctgggctgcctggtcaaggactacttccagtcgctaga

SEQ ID NO: 458820 - DNA, 519 bp, Homo sapiens
  misc_feature: HEFZJCU01CJYFW.49.19.B08.1.454.heavy.3.raw
agtcgagagacacgaccggtgctcgatttagtgagtcagtaaggggctgagagaggagcccagccctgggattttcaggtgttttcatgtggtgatcaggactgaacagagagaactcaccatggagtctgggctgacgtggcttttgcttgtggctatcttaaaaggtgtccagtgtgacgtgcagttggtggagtcgggggaggcttgggtacagccgggggggtccctgagactctcctgtacagtctctggcttcacctttagagtctatgacatgagttgggtccgccaggctccggggaaggggctggagtgggtctcaacgatcagtgatagtggaactaagacaaactatgccgactccgtgaagggccatgcaccatctccagagacaactcgaaggacactttatatctgcaactcaacagactgacaaccgcggacgcggccgtctattactgtgtgaaagagacggaccgctggacgaggagccagaggaaaatcgaactactttga

SEQ ID NO: 458821 - DNA, 496 bp, Homo sapiens; identical to SEQ ID NO: 446592
  misc_feature: HEFZJCU01BOSIA.4.75.G09.1.454.heavy.3.raw

SEQ ID NO: 458822 - DNA, 512 bp, Homo sapiens
  misc_feature: HEFZJCU01EMKGP.51.37.D04.1.454.heavy.3.raw
cgatcgtatacacgaccggtgctcgatttagtagcatactgttgggttttccttgttgctattatagaaggtgtccagtgtcaggtgcagctggtggaatctgggggaggcttggtcaagcctggagggtccctgagactctcctgtgcagcctctggattcaccttcagtggctacttcatgagctggatccgccaggctccagggaaggggctgcagtgggtctcacatattagtgctaatgggagaaccacattctacgcagactctgtgaagggccgattctccatctccagggacaacgccaagaactcactgtatctgcaaatgaacagtctaagagccgaagacacggccgtgtacttctgtgcgagtgtgggagaggactacggtgacacggagcctttctcctactacttcggtgtggacgtctggggccaagggaccacggtcaccgtctcctcagcctccaccaacgggcccatcggtccttcccctggccaccctcctcc

SEQ ID NO: 458823 - DNA, 506 bp, Homo sapiens; identical to SEQ ID NO: 449588
  misc_feature: HEFZJCU01CJLQ9.11.72.G06.1.454.heavy.3.raw

SEQ ID NO: 458824 - DNA, 500 bp, Homo sapiens
  misc_feature: HEFZJCU01C13S9.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaatgttttctgtcatcgtacaatttgaataggctctatggactggacttc

SEQ ID NO: 458825 - DNA, 526 bp, Homo sapiens
  misc_feature: HEFZJCU01A18DL.53.10.A10.1.454.heavy.3.raw
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgttctgcagatgcacaacttgagagtcgaagacacggcggtctatttctgcgcgaggaaaagtcgcattccagagcctgtacgcccgccttggtctcgtcagttggtcaatccgccctccagggggacctttggggtttcgacccctggggccaggggaaccctggtcaccggtctcctcacgcctccaccaagggcccatcggtcttcccctggcaccctctccaagagcacctcg

SEQ ID NO: 458826 - DNA, 374 bp, Homo sapiens; identical to SEQ ID NO: 444640
  misc_feature: HEFZJCU01A5AM2.7.37.D04.1.454.heavy.3.raw

SEQ ID NO: 458827 - DNA, 500 bp, Homo sapiens; identical to SEQ ID NO: 445080
  misc_feature: HEFZJCU01EDEIK.3.81.H04.1.454.heavy.3.raw

SEQ ID NO: 458828 - DNA, 521 bp, Homo sapiens
  misc_feature: HEFZJCU01E0MYA.16.67.G01.1.454.heavy.3.raw
tgtactactccacgaccggtgctcgatttagagtatacatattgggtttggggtctgagagaggagcccagccctgggatttccaggtgttttcatttggggatcaggactgaacagagagaactcaccatggagttagggctgagctggctttttcttgtggctattttaaaaggtgtccagtgtgaggtgcagctgttggagtctgggggaggcttggtacagcctggggggtccctgagactctcctgtgcgacctctggattcacctttagcagctatgccatgagctgggtccgccaggctccagggaaggggctggagtgggtctcaactattagtggtagtggtggtaccacatacttcgctgactccgtgaagggccggttctccatctccagagacacttccaagaacacggtgtatctgcaagtgcacagcctgagagccgaggacacggccatatattactgtgcgaaagatcgacttccccctccgtacgagatggctacaaaatcttt

SEQ ID NO: 458829 - DNA, 495 bp, Homo sapiens
  misc_feature: HEFZJCU01A062G.49.35.D02.1.454.heavy.3.raw
agtcgagagacacgaccggtgctcgatttagcacacgatagttgggtttggggatcacataacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcacccctatccttaatatagcaaactatgcacagacattccacgacagagtcacccttatcgcggacaaatccacgaacacagcctacatggaactgcgcagcctaggatctgtcgacacggccgtatatttctgtgcgagagagatgtctttctatgatagtactagtcattat

SEQ ID NO: 458830 - DNA, 508 bp, Homo sapiens
  misc_feature: HEFZJCU01EF3C4.21.70.G04.1.454.heavy.3.raw
tcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggaccgcagtcaccgtctcctcagcctccaccaagggcccatcggtcttcccctggcgccctgctccaggagcacctccga

SEQ ID NO: 458831 - DNA, 312 bp, Homo sapiens; identical to SEQ ID NO: 444415
  misc_feature: HEFZJCU01EX7JI.7.10.A10.1.454.heavy.3.raw

SEQ ID NO: 458832 - DNA, 530 bp, Homo sapiens
  misc_feature: HEFZJCU01BC4NM.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaccctggtcaccgtctcctcagcctccaccaagg

SEQ ID NO: 458833 - DNA, 491 bp, Homo sapiens; identical to SEQ ID NO: 444749
  misc_feature: HEFZJCU01COS9H.11.13.B02.1.454.heavy.3.raw

SEQ ID NO: 458834 - DNA, 518 bp, Homo sapiens
  misc_feature: HEFZJCU01EKKTU.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgaccctggggccagggaaccctggtcaccgtctcctcag

SEQ ID NO: 458835 - DNA, 530 bp, Homo sapiens
  misc_feature: HEFZJCU01ECNGU.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtgggattggatacatctattactttgggagcacctactacaacccgtccctcaagagtcgagtaacgatctcagtggacacgtctaacaatcacctctccctgaggctgagctctgtgacagccgcggacacgggctttattactgtgcggagaggggacggactacggtgactactgggggttcgaccccgtggggccagggaaccctggtcaccgtctcctcagcctccaaccg

SEQ ID NO: 458836 - DNA, 517 bp, Homo sapiens
  misc_feature: HEFZJCU01EE3KN.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaacccgtggtcgccgtctcctcagcctccaccaagggcccatcggtcttcccctggcaccctcctccaagagcacctctgggggcacagcggccctggctgcctggtcaaggactacttccagacgtatca

SEQ ID NO: 458837 - DNA, 492 bp, Homo sapiens
  misc_feature: HEFZJCU01A9VKG.19.1.A01.1.454.heavy.3.raw
tactctcgtgcacgaccggtgctcgatttagacgtctcatcaggggatcacataacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagccctggacaagggcttgagtggatgggaggaagcatccctttctttgatactccagactacgcacagaagttccagggcagagtcacgattaccgcggacgaatccacgagcacagtctatatggaattgaccagcctgacatcagaggacacggccgtctattttgttgcgacagaaagagattccatactcaggcggggcactatggcagc

SEQ ID NO: 458838 - DNA, 503 bp, Homo sapiens
  misc_feature: HEFZJCU01EW1Y2.10.38.D05.1.454.heavy.3.raw
  modified_base (474)..(474): a, c, t, g, unknown or other
catagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtcttcccctgcgcctgctccaggagcacctccgagagcacagccggcctgggcngcctggtcaaggactacttcccactacta

SEQ ID NO: 458839 - DNA, 505 bp, Homo sapiens
  misc_feature: HEFZJCU01DCU0C.48.29.C07.1.454.heavy.3.raw
agtatacatacacgaccggtgctcgatttagagtgctacgaagggaggcttggtccagcctggggggtccctgaaactctcctgtacagcctctgggttcgccttcacagcctctgggttcagcttcagtgcctctgctatgcactgggtccgccaggcttccgggagagggcttgagtgggttggccgtattagaacaaaacctaataattacgcgacagcatttgctgcgtcggtgagaggcaggttcaccctcctcagagacgattccaagaacacggcgtatctgcaaatggacaacctgaaaaccgaggacacggccgtttattattgtacttctgaggtgacgggaaccgctggctattggggccagggaaccctggtcgccgtctcctcagcctccaccaagggcccatcggtcttcccctggcgccctgctccaggagcacctccgagagcacagcggcctgggctgcctggtcaaggactacttcctatgtatact

SEQ ID NO: 458840 - DNA, 522 bp, Homo sapiens
  misc_feature: HEFZJCU01AC3MW.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcctttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttccccctggcc

SEQ ID NO: 458841 - DNA, 526 bp, Homo sapiens; identical to SEQ ID NO: 446836
  misc_feature: HEFZJCU01DW16Z.11.25.C03.1.454.heavy.3.raw

SEQ ID NO: 458842 - DNA, 499 bp, Homo sapiens
  misc_feature: HEFZJCU01B3CR0.3.23.C01.1.454.heavy.3.raw
agacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctcgtcaccgtctcctcagcctccaccacggcccatcggtcttcccc

SEQ ID NO: 458843 - DNA, 494 bp, Homo sapiens
  misc_feature: HEFZJCU01DSOQ4.40.81.H04.1.454.heavy.3.raw
tctagcgactcacgaccggtgctcgatttagtagtgtagattcgcgggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactc

SEQ ID NO: 458844 - DNA, 478 bp, Homo sapiens
  misc_feature: HEFZJCU01ED4ZW.22.36.D03.1.454.heavy.3.raw
  modified_base (246)..(246): a, c, t, g, unknown or other
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacncagtgaatctgcaaatgtacagcctcagcgccgaggacacggccgtctacttctgtgcgaagacctctatttttgggccgcggccgactactggggccagggcaccctggtcaccgtctcttcagcctccaccaagggcccatcggtcttcccctggcgcctgctccaggagcacctccgagagcacagcggccctgggctgcctggtcaaggactacttccacgcgtatgt

SEQ ID NO: 458845 - DNA, 510 bp, Homo sapiens
  misc_feature: HEFZJCU01CO4WM.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttctccctgaagctgagctctgtgactgccgcggacacggccgtgtattactgtgcgaggtcgattgtgatggtaacaactgcttcttactcctttgaccagtgggccgaggaaccctggtcaccgtctcttcagcctccaccaaggcccatcggtcttcccctggccaccctcctccagagcacctctggggc

SEQ ID NO: 458846 - DNA, 518 bp, Homo sapiens
  misc_feature: HEFZJCU01DOLGS.51.62.F07.1.454.heavy.3.raw
cgatcgtatacacgaccggtgctcgatttagtagtcgcataaagggaaagggggcatcacataacaaccagattcctcctctaaagaagcccctgggagcacagttcatcaccatggactggacctggaagttcctctttgtggtggcagcagcaacaggtgtccagtcgcaggtccagctggtgcagtctgggactgaggtgaagaggcctgggtcctcggtgaaggtctcctgcaaggcatctaaaaacatcttaagaagttatgacatcgcctgggtgcgacaggcccctggacatgggcttgagtgggtgggcaggatcatccctatgtttggagtcgcaaactacgcacagaagttccgggcaaagtcacgttgaccgcggacacagtcacggacacagcctacatggaactcaacggcctcagatttgaggacacggccgtctattattgtgcgagagtgagaaattacggtggctactcccttgacctactggggccaggggaaccctggt

SEQ ID NO: 458847 - DNA, 501 bp, Homo sapiens
  misc_feature: HEFZJCU01DAWA4.40.81.H04.1.454.heavy.3.raw
tctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctggaccacgtggggccg

SEQ ID NO: 458848 - DNA, 496 bp, Homo sapiens; identical to SEQ ID NO: 458116
  misc_feature: HEFZJCU01EN0R3.3.26.C04.1.454.heavy.3.raw

SEQ ID NO: 458849 - DNA, 486 bp, Homo sapiens; identical to SEQ ID NO: 444861
  misc_feature: HEFZJCU01EYRWK.47.55.E11.1.454.heavy.3.raw

SEQ ID NO: 458850 - DNA, 392 bp, Homo sapiens; identical to SEQ ID NO: 444682
  misc_feature: HEFZJCU01CQOCF.16.70.G04.1.454.heavy.3.raw

SEQ ID NO: 458851 - DNA, 507 bp, Homo sapiens
  misc_feature: HEFZJCU01AGNI7.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaatacgctgtatctgcaaatgaacagcctgagagtcgaggacacggccgtatattattgtgcgaaagacgtatgtagtggtgactgcttgtttggagcttttgactactggggccagggaaccctggtcatcgtctcctcagcctccaccaagggcccatcggtcttcccctggcaccctcctccaagagcacctctgggggcacgagcggccctgggctgcctggtcaaggactacttccgagtagtaca

SEQ ID NO: 458852 - DNA, 482 bp, Homo sapiens
  misc_feature: HEFZJCU01A5Z0U.49.32.C10.1.454.heavy.3.raw
agtcgagagacacgaccggtgctcgatttagtatagacatcaacacacaaaggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggaggcgtggtccagcctgggaggtccctgagactctcctgtgcagcctctggattcaccttcagggtctatgacatgcactgggtccgccaggctccaggcaaggggctggagtgggtggcagttatgtcatatgatggaagtaatatatactatatagactccgtgaagggccgattcatcatctccagagacaattccgagaacacgctgtatctgcaaatgaacagcctgagagttgaggacacggctgtgtattattgtgcgaactt

SEQ ID NO: 458853 - DNA, 520 bp, Homo sapiens
  misc_feature: HEFZJCU01D5CKU.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacgacggccgtctattactgtgcgatacgtcccacgatcccggtgacgcctacggcaggccggtcctttgaccttcgtggggcccaggggaccg

SEQ ID NO: 458854 - DNA, 491 bp, Homo sapiens; identical to SEQ ID NO: 445531
  misc_feature: HEFZJCU01BH02P.11.38.D05.1.454.heavy.3.raw

SEQ ID NO: 458855 - DNA, 521 bp, Homo sapiens
  misc_feature: HEFZJCU01D3XYR.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatacatgggggcttgttctggggccagggacctggtcatcgtctcccagcctccaccaagggccatcggtcttcccctggcgcctcg

SEQ ID NO: 458856 - DNA, 497 bp, Homo sapiens
  misc_feature: HEFZJCU01BZR2P.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggccaagggacaatggtcaccgtct

SEQ ID NO: 458857 - DNA, 324 bp, Homo sapiens; identical to SEQ ID NO: 444475
  misc_feature: HEFZJCU01D8Z0C.18.17.B06.1.454.heavy.3.raw

SEQ ID NO: 458858 - DNA, 530 bp, Homo sapiens
  misc_feature: HEFZJCU01DV6OF.51.58.F03.1.454.heavy.3.raw
cgatcgtatacacgaccggtgctcgatttagtctgatcgagaagggaaaggggggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcactgtctctggtggctccatcagcagcagtagttacttctggggctggatccgccagcccccagggaagggactggagtggatagggaatgtccattatagtgggagcacctactacaatccgtccctcaacagtcgagtcaccatatccgttgacacgtccaagaaccaattcttcctgaggctgacctctgtgaccgccgcagatacggcagtttattactgtgcaagaaagaactaccttgaaaactgggccacggaaccctggtcaccgtctcctcagcctccaccaagggcccatcggtccttccccctcggccaccctcctccaagacg

SEQ ID NO: 458859 - DNA, 487 bp, Homo sapiens
  misc_feature: HEFZJCU01CVX0L.4.6.A06.1.454.heavy.3.raw
agcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaatccctccctcaagagtcgactcaccatctcggctgacccgtcaagaatcagttctccctgaggctgacctctgtgaccgccgctgacacggccgtctattactgtgggagacagtgcagtggtggttcgtgccccgagtactggggccgcggaatcttggtcaccgtctcctcagcctccaccaagggcccatcggtcttcccctggcgccctgctccaggagcacctccgagagcacagcggccctgggctgcctggtcaaggactacttccctacagtgct

SEQ ID NO: 458860 - DNA, 507 bp, Homo sapiens
  misc_feature: HEFZJCU01CM7ZB.53.62.F07.1.454.heavy.3.raw
cgcgtatacacacgaccggtgctcgatttagtagtcgcataaagggaaaggggaagactgacggtcctcccaggtgtccagtgtcacgtgcagctggtgcagtctgggggaggcgtggtccagcctgggaggtccctgaaactctcctgtgcagcctctggattcgtctcaagtgtctaccctatgcactgggtccgccaggctccaggcaaggggctggagtgggtggcacttatctcatctgatggaagagatgtctattacgcagactccgtgaagggccgattcaccatctccagagacaattccaagaacacactgtatctgcaaatggacagtctgagaactgaagacacggctgtgtattactgtgcgagtgagatgtcttactatgatgccagtggtttagtaccgttcgacccctggggccagggaaccctggtcaccgtctcctcagcttccaccaaggcccatcggtcttccccctcggccgccctgctccaggag

SEQ ID NO: 458861 - DNA, 504 bp, Homo sapiens; identical to SEQ ID NO: 447493
  misc_feature: HEFZJCU01BQZ7X.48.23.C01.1.454.heavy.3.raw

SEQ ID NO: 458862 - DNA, 400 bp, Homo sapiens; identical to SEQ ID NO: 444452
  misc_feature: HEFZJCU01BH956.47.24.C02.1.454.heavy.3.raw

SEQ ID NO: 458863 - DNA, 513 bp, Homo sapiens
  misc_feature: HEFZJCU01AJ7U7.21.35.D02.1.454.heavy.3.raw
tcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctgaaagaagaggacacggctgtatataactgtgcgcgaggaccttattattattggttcagggaccattgacttacgtggggccaggggaaccctggtccaccgtctcctcacgcctccaacccg

SEQ ID NO: 458864 - DNA, 529 bp, Homo sapiens
  misc_feature: HEFZJCU01DB7RI.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttatactgtgcgagagggacggactacggtgactactgggggttccgaccccgtggggccagggaaccctggtccaccgtctcctcagcctccaaccg

SEQ ID NO: 458865 - DNA, 496 bp, Homo sapiens
  misc_feature: HEFZJCU01BZLS6.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaagatttctatagaggtgacgtacggggcttcg

SEQ ID NO: 458866 - DNA, 500 bp, Homo sapiens
  misc_feature: HEFZJCU01CJJJN.48.73.G07.1.454.heavy.3.raw
agtatacatacacgaccggtgctcgatttagctctacgctcagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggtctttttgtatgcctttgatatgtgggccaagggacaatggtcaccgtct

SEQ ID NO: 458867 - DNA, 521 bp, Homo sapiens
  misc_feature: HEFZJCU01CAUMF.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccagggcccatcggtcttccccctggcg

SEQ ID NO: 458868 - DNA, 390 bp, Homo sapiens; identical to SEQ ID NO: 444541
  misc_feature: HEFZJCU01E10ZC.16.24.C02.1.454.heavy.3.raw

SEQ ID NO: 458869 - DNA, 490 bp, Homo sapiens
  misc_feature: HEFZJCU01D5V97.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcagggccctcccacatcggttatttctttgactcctggggccagggaaccctggcaccgtctcctc

SEQ ID NO: 458870 - DNA, 519 bp, Homo sapiens
  misc_feature: HEFZJCU01EYKK5.9.34.D01.1.454.heavy.3.raw
tgatacgtctcacgaccggtgctcgatttagatcgtctgtgttgagtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcatcagcctccaccaagggcccatcggtcttccccctggcaccctcctccaagagcacctctgggggcacagcggccctgggctgcctggtcaaggactacttccagacgtatcac

SEQ ID NO: 458871 - DNA, 405 bp, Homo sapiens
  misc_feature: HEFZJCU01EM3Y0.11.70.G04.1.454.heavy.3.raw
cgagagataccacgaccggtgctcgatttagtgtagtgtgaagggaaagggactggagtggattggtcatatcgataccactggaaacaccaattacaacccctccctcaagagtcgagtcaccatatccctgacgtccaagagtcagctctccctggagctgacttctgtgaccgccgcagacacggccgtgtattacgtgtgcgcgacgtcgtcccttgaaagtaattgttagggacctccactacggtatggacgtctggggccaagggaccacggtcaccgtctcctcagcctccaccaagggcccatcggtcttccccctggcaccctcctccaagagcacctctgggggcacagcggcccgtgggctgcctggtcaaggactacttccgtatctcctcg

SEQ ID NO: 458872 - DNA, 513 bp, Homo sapiens
  misc_feature: HEFZJCU01CGYNS.51.5.A05.1.454.heavy.3.raw
cgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctatttctgtgcgagactgcccggtctgcacctcgtgtggccccaatttggtttaccggcacacaaaatcagggcaagtcctacgacggtctggtacg

SEQ ID NO: 458873 - DNA, 509 bp, Homo sapiens
  misc_feature: HEFZJCU01CSC9F.52.57.F02.1.454.heavy.3.raw
cgcagtacgacacgaccggtgctcgatttagctcgatatagttgggtttgggggaggcttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctgggccgtggcacctggtcactgtcttctcagcctccaccaacgggcccatcggtcttcccctggcaccctcctccaagagcacctctgggggcacagcggccctgggctgcctggtcaggactactcct

SEQ ID NO: 458874 - DNA, 527 bp, Homo sapiens
  misc_feature: HEFZJCU01A8P3Q.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagaggggacggactacggtgactactgggggttcgacccctggggccagggaaccctggtcaccgtctcctcagcctccaccg

SEQ ID NO: 458875 - DNA, 522 bp, Homo sapiens
  misc_feature: HEFZJCU01CEU79.10.85.H08.1.454.heavy.3.raw
catagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaaaaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctcgtggggccagggaaccctggtcaccgtctcatcagcctccaccaacgggccc

SEQ ID NO: 458876 - DNA, 489 bp, Homo sapiens; identical to SEQ ID NO: 454883
  misc_feature: HEFZJCU01CZLN1.10.71.G05.1.454.heavy.3.raw

SEQ ID NO: 458877 - DNA, 501 bp, Homo sapiens
  misc_feature: HEFZJCU01CALU8.21.70.G04.1.454.heavy.3.raw
tcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggaccgcagtcaccgtctcctcagcctccaccaagggcccatcggtcttcccctggcgcctgctccaggagcacctccgagagcacagcggccctgggctgcctggtcaaggactacttcccgagcgacga

SEQ ID NO: 458878 - DNA, 500 bp, Homo sapiens
  misc_feature: HEFZJCU01CUTIS.47.56.F01.1.454.heavy.3.raw
  modified_base (472)..(472): a, c, t, g, unknown or other
agctcacgtacacgaccggtgctcgatttagcagacgtctgaacacacaaagggggccccagccctgggattcccagctgtttctgcttgctgatcaggactgcacacagagaactcaccatggagtttgggctgagctgggttttccttgttgctattttaaaaggtgtccagtgtgaggtgcaactggtggagtccgggggaggcttaattcagcctggggggtccctgagactctcctgtgcagcctctggattcaccttcagtagttactggatgcactgggtccgccaagctccagggaagggactggtgtgggtctcacgtattaatcctgatggaagtcgcacaaactacgcggactccgtgagggaccgattcaccatctccagagacaacgccaagaacacgctgtatctgcaaatgcacagtctgagagccgacggatgcggctgtatatttctgtgcaagngatcaactggtgggaccgactttatttc

SEQ ID NO: 458879 - DNA, 513 bp, Homo sapiens
  misc_feature: HEFZJCU01BV65I.47.55.E11.1.454.heavy.3.raw
agctcacgtacacgaccggtgctcgatttagcactcgcacgttgggtttggggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaacccg

SEQ ID NO: 458880 - DNA, 510 bp, Homo sapiens
  misc_feature: HEFZJCU01DGLIJ.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccgtctacgattggggagcgactggttcgacccctggggccagggaaccctggtcaccgtctcctcagcctccaccaacgggcccatcggtcttcccctggcaccctcctccaagagcacctctgggggcacagcggccctgggctgcctggtcaaggactacttcctacgtcgtat

SEQ ID NO: 458881 - DNA, 391 bp, Homo sapiens; identical to SEQ ID NO: 444514
  misc_feature: HEFZJCU01EQSY7.12.24.C02.1.454.heavy.3.raw

SEQ ID NO: 458882 - DNA, 491 bp, Homo sapiens; identical to SEQ ID NO: 447981
  misc_feature: HEFZJCU01CG4YZ.47.85.H08.1.454.heavy.3.raw

SEQ ID NO: 458883 - DNA, 527 bp, Homo sapiens
  misc_feature: HEFZJCU01EF8HU.14.35.D02.1.454.heavy.3.raw
cgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactgggccagggaaccctggtcaccgtctcctcagcctccaccaagggcccatcggtcttcccctggcaccctcctccaagagcacctctgggggcacagcggccctgggctgcctggtcaggactacttaccg

SEQ ID NO: 458884 - DNA, 491 bp, Homo sapiens; identical to SEQ ID NO: 445333
  misc_feature: HEFZJCU01BG19O.19.53.E09.1.454.heavy.3.raw

SEQ ID NO: 458885 - DNA, 505 bp, Homo sapiens; identical to SEQ ID NO: 447076
  misc_feature: HEFZJCU01AQ2CQ.10.38.D05.1.454.heavy.3.raw

SEQ ID NO: 458886 - DNA, 512 bp, Homo sapiens
  misc_feature: HEFZJCU01D10LM.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaagggctggagtgggtggccagcatgaacggagatggaagtcaaaagaactatgtggactctgtgaagggccgattcaccatctccagagacaacgccaaagaactcactgtatctgcaaatgaacagcctaagacccgaggacacggctgtgtattactgtgcgagagaccgctacgtgggggcccgggagtccgtggt

SEQ ID NO: 458887 - DNA, 506 bp, Homo sapiens
  misc_feature: HEFZJCU01BTVCB.10.88.H11.1.454.heavy.3.raw
catagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcacagcctacatgaactgaggagcctgagatctgacgacacggccgtatatttctgcgcgagagacgtaaagtgacgtggtagttccgggggacacgatgactaccg

SEQ ID NO: 458888 - DNA, 509 bp, Homo sapiens
  misc_feature: HEFZJCU01A61VP.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactgggcgattatacatattatacagactccgtgaagggccgcttcaccatctccagagacaattccaagaacacggtgtatctgcaaatgaacagcctgagagccgaggacacggccacatattactgtgacgaagatctcgggctggttccgcggtccgggt

SEQ ID NO: 458889 - DNA, 506 bp, Homo sapiens; identical to SEQ ID NO: 446520
  misc_feature: HEFZJCU01BHYT5.10.38.D05.1.454.heavy.3.raw

SEQ ID NO: 458890 - DNA, 515 bp, Homo sapiens
  misc_feature: HEFZJCU01C2OAX.4.33.C11.1.454.heavy.3.raw
agcactgtagcacgaccggtgctcgatttagagtgagctcgttgggtttgggggggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggagttttacgatttttggtagtggatattaa

SEQ ID NO: 458891 - DNA, 395 bp, Homo sapiens
  misc_feature: HEFZJCU01CY8SY.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagccaccaccaagggcccatcggtcttccccctggcgccctgctccaggagcacctccgagagcacagcggccctgggctgcctggtcaaggactacttccgagtagtaca

SEQ ID NO: 458892 - DNA, 528 bp, Homo sapiens
  misc_feature: HEFZJCU01EBFB9.16.37.D04.1.454.heavy.3.raw
tgtactactccacgaccggtgctcgatttagtagcatactgtgggtttgggggagacttagtacagccgggggggtccctgagactctcctgtgcagcctctggattcaccttcagcaattactggctgcactgggtccgccaagctccagggaaggggctggtgtgggtctcacatattaatctcgatgggagtaatttagcctacgcggactccgtcaagggccgattcaccgtctccagagacaacaccaagaacacactatatctgcagattgacagtctgagacccgaggacacggctgtgtattactgtgcaaggcagttcgtggaaacagttatggttggggggagtgggtttttttttcgtactacgggatggacgtctggggccgagggaccgcggtcaccgtctcctcagcctccaccaagggcccatcggtcttcccctggccaccctcctccaagagcacctctgggggcacagcggcctgggctgcctggtcaaggactacttccgagtagtaca

SEQ ID NO: 458893 - DNA, 491 bp, Homo sapiens
  misc_feature: HEFZJCU01ED824.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtatttactgtgcaaggaggtatagcagctactggtacgactactggggccagggaaccctggtcaccgtctcctcagcctccaccaaggcccatcggtcttcccctggcgccctgctccaggagcacctccgagagcacagcggccctgggctgcctggtcaaggactacttcccacgagagta

SEQ ID NO: 458894 - DNA, 504 bp, Homo sapiens
  misc_feature: HEFZJCU01AWURH.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttggacttctc

SEQ ID NO: 458895 - DNA, 492 bp, Homo sapiens
  misc_feature: HEFZJCU01DDQI3.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggtcgattcaccatctccagagacaattcccagaacacggtctatctgcacctgaccagcctgagaactgacgacacgtctctctactactgtgcgagagagttgacgagtc

SEQ ID NO: 458896 - DNA, 527 bp, Homo sapiens
  misc_feature: HEFZJCU01DK2Z1.9.78.H01.1.454.heavy.3.raw
tgatacgtctcacgaccggtgctcgatttagtgtgagtagtttgggtttgggtaccgaagttgctggaagtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttccagt

SEQ ID NO: 458897 - DNA, 490 bp, Homo sapiens
  misc_feature: HEFZJCU01DGFNH.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacgacccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggactactccgagtgcgtct

SEQ ID NO: 458898 - DNA, 515 bp, Homo sapiens
  misc_feature: HEFZJCU01D6IE4.9.34.D01.1.454.heavy.3.raw
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagctccaccaaggcccatcggtcttcccctggcaccctcctccaagagcacctctggggcacagcggccctgggctgcctggtcaaggactacttccagacgtatca

SEQ ID NO: 458899 - DNA, 466 bp, Homo sapiens
  misc_feature: HEFZJCU01ATCJY.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactggggacgggggaaaagttggggccagggaaccctggtctccgtctcgtcagcctccaccaagggcccatcggtcttcccctggcgccctgctccaggagcacctccgagagcacagcggccctgggctgccctggtcaaggactacttcccacgagagtta

SEQ ID NO: 458900 - DNA, 470 bp, Homo sapiens; identical to SEQ ID NO: 445307
  misc_feature: HEFZJCU01COIIK.12.78.H01.1.454.heavy.3.raw

SEQ ID NO: 458901 - DNA, 483 bp, Homo sapiens; identical to SEQ ID NO: 444924
  misc_feature: HEFZJCU01B8Z5Y.10.35.D02.1.454.heavy.3.raw

SEQ ID NO: 458902 - DNA, 489 bp, Homo sapiens; identical to SEQ ID NO: 454883
  misc_feature: HEFZJCU01BBLO4.10.71.G05.1.454.heavy.3.raw

SEQ ID NO: 458903 - DNA, 517 bp, Homo sapiens
  misc_feature: HEFZJCU01ER8W7.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtcctttttgaccagtggggccagggaaccctggtcaccgtctcctcagcttccaccaagggcccatcggtcttcccctggcgccctgctccaggagcacctctgggggcgacagcggcccg

SEQ ID NO: 458904 - DNA, 523 bp, Homo sapiens
  misc_feature: HEFZJCU01APFFP.49.24.C02.1.454.heavy.3.raw
agtcgagagacacgaccggtgctcgatttagtacagatcgttagggaaaggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatgagcagtagtaattactactggggctgggtccgccagcccccagggaaggggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaaggggaccacggtcaccgtctcctcagcctcc

SEQ ID NO: 458905 - DNA, 509 bp, Homo sapiens
  misc_feature: HEFZJCU01A2LY7.4.67.G01.1.454.heavy.3.raw
agcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgcgttttcttaggtggctattttaaaaggtgtccagtgtgaagtgcagctggtggagtctgggggaggcctggcacagccgggggggtccctgagactctcctgtgcagcctctggattcagttttagaatgtctgccatgacctgggtccgccaggctcctgggaaggggctggagtggatctcagggattagtggcactggcgattatacatattatacagactccgtgaagggccgcttcaccatctccagagacaattccaagaacacggtgtatctgcaaatgaacagcctgagagccgaggacacggccacatattactgtgcgaaagatctcgggctggttccgcggtccggg

SEQ ID NO: 458906 - DNA, 506 bp, Homo sapiens
  misc_feature: HEFZJCU01AKOFB.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaaagccaagaactccctgttctgcaaatggacaatttgagagaggaagacacggccttagtatttctgtgcgagagccctcggcagaagtctggactactactattatggtatggacgtctggggccaagggaccacggtcatcgtctcctcagcctccaccaagggcccatcggtcttccccctggcaccctcctccaagagcacctctgggggcacagcggccctgggctgcctggtcaaggactacttcctacgtcgtat

SEQ ID NO: 458907 - DNA, 520 bp, Homo sapiens
  misc_feature: HEFZJCU01C6JQI.52.53.E09.1.454.heavy.3.raw
cgcagtacgacacgaccggtgctcgatttagagagagtgtgttgggtttgggagaggagcccagcactgggattccgaggtgtttccattcagtgatctgcactgaacacagaggactcgccatggagtttgggctgagctgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccaggggggcggagcagccccgtaattctggggccaggggaacccc

SEQ ID NO: 458908 - DNA, 509 bp, Homo sapiens
  misc_feature: HEFZJCU01EII8Y.22.82.H05.1.454.heavy.3.raw
acatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaaggggccggagtgggtgtcagtcattagtagtagtggtgatagaatttaccacacagactccgtgaagggccgcttcaccatctctagagacaattcccagaacacactgtatctgcaaatgactaggctgagagccgacgacacggccatttattactgcgcgaaggatatacgggtcacgaacggtggctacgcgttt

SEQ ID NO: 458909 - DNA, 532 bp, Homo sapiens
  misc_feature: HEFZJCU01D8VZY.52.53.E09.1.454.heavy.3.raw
cgcagtacgacacgaccggtgctcgatttagagagagtgtgttgggttttccttgttgctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccaggggaaggggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccgagggggccgggagcagccccgtaacttcgtgggccgagggaacccgggtcaccgtctcctcagcctccaccaagggcccatcggtcttccccctggccaccctcctccaagagcacctctgggggcacgagccggccctgggctgcctggtc

SEQ ID NO: 458910 - DNA, 500 bp, Homo sapiens
  misc_feature: HEFZJCU01BS3NS.10.34.D01.1.454.heavy.3.raw
catagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccatattaaaatcaaagctgatggtgggacaacagagcacgctgcacccgtgaaaggcagattcagcatctcaagagatgattacaaaaagtacgctgtatctgaacatgaacagcctgaaaacggaggacacagccgtgtattactgtgccactcaggaccgatattgtt

SEQ ID NO: 458911 - DNA, 514 bp, Homo sapiens
  misc_feature: HEFZJCU01EKVZZ.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactgggtggtggttataccacatactacgcagactccgtgaagggccggttcaccatctccagagacaattccaagaacacactgtatctgcaaatgaacagcctgagagccgacgacacggccatactattactgtgcgaaagcaccggcagttagtcacccatactactttgactacgtggggaccg

SEQ ID NO: 458912 - DNA, 522 bp, Homo sapiens
  misc_feature: HEFZJCU01D1ZAZ.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctgggccaagggaccacggtcatcgtctcctcagcctccaccaagggcccatcggtcttcccctggcaccctcctccaagagcacctctgggggcacagcc

SEQ ID NO: 458913 - DNA, 530 bp, Homo sapiens
  misc_feature: HEFZJCU01DU91L.4.14.B03.1.454.heavy.3.raw
agcactgtagcacgaccggtgctcgatttagtgtgagtagttccgcgggggagagaggagccttagccctggattccaaggcctatccacttggtgatcagcactgagcaccgaggattcaccatggaactggggctccgctgggttttccttgttgctctttttggaggtgtccagtgtgaggtacaactggtggactctgggggaggcctggtcaggcctggggggtccctgagactctcctgtgcagcctctggattcaccttcggaaactatcacatgaactgggtccgccaggctccagggaaggggctggagtgggtctcctgtattagtagtgccggcacttacacatactatgcagactcagtgaagggccgattcaccatctccagagacaacgccaagaactcactgtttcttcaaaatggacagcctcagagtcgacgacacggctgtgtatttacttgtgcgagagcggttagtggtggttactttccggggcaacgtggggccgagggaaccctggt

SEQ ID NO: 458914 - DNA, 502 bp, Homo sapiens; identical to SEQ ID NO: 445414
  misc_feature: HEFZJCU01COZUW.17.25.C03.1.454.heavy.3.raw

SEQ ID NO: 458915 - DNA, 509 bp, Homo sapiens
  misc_feature: HEFZJCU01DYJHC.14.21.B10.1.454.heavy.3.raw
cgtctagtaccacgaccggtgctcgatttagtgtcgtcgcaggagagaggagcccagccctgggattttcaggtgttttcattcggtgatcaggactgaacagagagaactcaccatggagtttgggctgagcgtggcttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagtatttttggagttggttattattacctttgtactcg

SEQ ID NO: 458916 - DNA, 501 bp, Homo sapiens
  misc_feature: HEFZJCU01C6BH6.49.83.H06.1.454.heavy.3.raw
  modified_base (496)..(496): a, c, t, g, unknown or other
agtcgagagacacgaccggtgctcgatttagatcacgtgcgtcgcggggagtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcagcttctctgggttctcactctccagtcctggagtgggtgtgggctggatccgtcagcccccaggaaaggccctggagtggcttgcactcatttattggaatgacgataagacctacagcccatctctgaagagcaggctcaccatcaccaaggacactccaacaaccaggtggtccttacaatgaccaacatggaccctgtggacacaagccacatattaactgtgcacacgtcccccgccgtattattatgatgctagtggttattccaacgctgaatactttccagcactggggccagggnacccg

SEQ ID NO: 458917 - DNA, 527 bp, Homo sapiens
  misc_feature: HEFZJCU01CL73O.17.34.D01.1.454.heavy.3.raw
  modified_base (401)..(401): a, c, t, g, unknown or other
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacccgaanacagttaatctggagctgaacagcctgtcatctgaggacacgggcttctacttctgtgcgaggagtattactatacactgctccttttacacctccttgacttctggggccatggaacccggtccg

SEQ ID NO: 458918 - DNA, 480 bp, Homo sapiens; identical to SEQ ID NO: 445011
  misc_feature: HEFZJCU01DN16M.22.36.D03.1.454.heavy.3.raw

SEQ ID NO: 458919 - DNA, 511 bp, Homo sapiens
  misc_feature: HEFZJCU01AHT7L.4.57.F02.1.454.heavy.3.raw
agcactgtagcacgaccggtgctcgattagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaagggctggaatgggtgcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtccttttgaccagtggggccagggaaccctggtcaccgtctcctcagcttccaccaagggcccatcggtcttcccctggcgccctgctccaggagcacctctggggcacagcggcccg

SEQ ID NO: 458920 - DNA, 505 bp, Homo sapiens
  misc_feature: HEFZJCU01BN59X.17.78.H01.1.454.heavy.3.raw
cgtagactagcacgaccggtgctcgatttagtgtgagtagtttgggtttgggggaccatatttggacccaacaaccacatccctcctcagaagcccccagagcacaacgcctcaccatggactggacctggaggatcctctttttggtggcagcagccacaggtgtccactcccaggtccatcttgtgcagtctggggctgagatgaagaagcctggggcctcagtgaaggtttcctgcaaggcttctggatacaccttcacgacgtatgctattcactgggtacgccaggcccccggacacagccttgagtggatgggatggatgaacgttgacaatgggaatacgagatattcacagaaattccagggcagagtcaccattaccagggacacatccgcgaacacagcctacatggagctgacgggcctgacatctgaagacacggctttatattactgtgcgcgagatggctggcacgagagggcacaactggctcgaccccg

SEQ ID NO: 458921 - DNA, 517 bp, Homo sapiens; identical to SEQ ID NO: 454763
  misc_feature: HEFZJCU01CM71D.3.17.B06.1.454.heavy.3.raw

SEQ ID NO: 458922 - DNA, 519 bp, Homo sapiens
  misc_feature: HEFZJCU01CEBGU.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaagggctggaatgggtctcagttattcataccgacggtaccatatatgacgcagactccgtgaagggccgattcaccatctccagagaccattccaagaacaccctatatcttcaaatgaacaacctgagagtcgaagacaacggccgtatattactgtgcgagacatgacttcggtgacccctggggccagggaaccctggtcaccgtctcctcag

SEQ ID NO: 458923 - DNA, 505 bp, Homo sapiens; identical to SEQ ID NO: 453332
  misc_feature: HEFZJCU01C67NG.17.25.C03.1.454.heavy.3.raw

SEQ ID NO: 458924 - DNA, 529 bp, Homo sapiens
  misc_feature: HEFZJCU01EGSER.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacggcttctacttctgtgcgaggagtaattactataacactgcttcctttttacaccttcccttgactttctgggccatcggaaccccggt

SEQ ID NO: 458925 - DNA, 374 bp, Homo sapiens; identical to SEQ ID NO: 447516
  misc_feature: HEFZJCU01BS92N.51.64.F09.1.454.heavy.3.raw

SEQ ID NO: 458926 - DNA, 529 bp, Homo sapiens
  misc_feature: HEFZJCU01BJ7H6.11.25.C03.1.454.heavy.3.raw
cgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctggatccagcctggggggtccctgagactctcctgtgcagcctctgggttcaccgtcagtcacacctacatgagttgggtccgccaggctccagggaagggctggagtgggtctcctttatttacaggcagtggtagtacatattccgcagactccgtgaggggccattcaccatctccagagacaactctaagaacacgctgttcttcaaatgaacagcctgagagccgatgacacggccgtgtattactgtgcgagagatgggggcccacgaacgttactacgctatggacgtcgtggggccgaacgggacctacc

SEQ ID NO: 458927 - DNA, 499 bp, Homo sapiens
  misc_feature: HEFZJCU01ECQLZ.5.41.D08.1.454.heavy.3.raw
atcagacacgcacgaccggtgctcgatttagtcacgcgagaaagggaaagggggcatcacataacaaccagattcctcctctaaagaagcccctgggagcacagctcatcaccatggactggacctggaggttcctctttgtggtggcagcagctacaggtgtccagtcccaggtgcagctggtgcagtctggggctgccgtgaagaagcctgggtcctcggtgacactctcctgcaaggcgtctggagccaccttcaccaactatgctttcaactgggtgcgacgggcccctgggcagggacttgagtggctggggcggatcatccctaccgttgatgtggcaaactatgcacagaagttccagggcagagtcacaattaccgcggacaagtccgcgagcacagcctacatggagctgaacaacctgagatctgaagacacggccgtctattactgtacgacctgcgctacggtgactaccgctctgcttcgggacct

SEQ ID NO: 458928 - DNA, 513 bp, Homo sapiens
  misc_feature: HEFZJCU01DRBHW.3.82.H05.1.454.heavy.3.raw
agacgcactccacgaccggtgctcgatttagtcgagctctctcgcggggctgggagaggagcccagcactgggattccgaggtgtttccattcggtgatcagcactgaacacagaggactcaccatggagttttggctgagcgtggttttccgttgttaggctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaaatgaacaacctgagagccgacgacacggccgtttattactgtgcgagagattcgagtggttcggggactcacctggttctcttcg

SEQ ID NO: 458929 - DNA, 540 bp, Homo sapiens
  misc_feature: HEFZJCU01CTT05.48.14.B03.1.454.heavy.3.raw
agtatacatacacgaccggtgctcgatttagtgtgagtagttccgcggggaggtctcagagaggagccttagccctggactccaaggcctttccacttggtgatcagcactgagcacagaggactcaccatggaattggggctgatctgggttttccttggttgctctttttggaggtgtccactgtgaggtgcaactggtggaatctgggggaggcttggtccagcctgggggctctctcagactctcctgtgaaacctctggattcacctttacgactttttggatgggttgggtccgccaggccccagggaaggggctgcagtgggtggccaacacaaatcaaaatggaaacgtggagtactatgcggagtctgtgaagggccggttcaccatctacagagacaacggcaagaagtcgctgtttctgcaaatgaacagcctgacctccgacgacacggctctctattattgtgtgtagagaatcctgggggaccggccgtcttcgggggccaggggaacactggttatcgtctcttc

SEQ ID NO: 458930 - DNA, 522 bp, Homo sapiens
  misc_feature: HEFZJCU01EHX6H.10.85.H08.1.454.heavy.3.raw
catagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatggttcggacctctggggccagggaaccctgggtcaccgtctcatcagcctccaccaagggccctacg

SEQ ID NO: 458931 - DNA, 520 bp, Homo sapiens
  misc_feature: HEFZJCU01DNFN2.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttggttctggggccaggggaccctggtcatcgtctccccagcctccaccaaggcccatcggtcttcccctggc

SEQ ID NO: 458932 - DNA, 528 bp, Homo sapiens
  misc_feature: HEFZJCU01BVNMA.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctgagctgaacagcctgtcatctgaggacacgggcttctacttctgtgcgaggagtaattactataacactgctccttttacacctcccttgacttctggggccatggaaccccggtcaccgt

SEQ ID NO: 458933 - DNA, 496 bp, Homo sapiens; identical to SEQ ID NO: 444697
  misc_feature: HEFZJCU01D7UD1.16.37.D04.1.454.heavy.3.raw

SEQ ID NO: 458934 - DNA, 502 bp, Homo sapiens
  misc_feature: HEFZJCU01EB7CV.17.10.A10.1.454.heavy.3.raw
cgtagactagcacgaccggtgctcgatttagcgtcgatctcaggggacccaaaaaccacacccctccttgggagaatcccctagatcacagctcctcaccatggactggacctggagcatccttttcctggtggcagcaggcacaggtgcccacgcccaggttcagttggtgcagactggggctgaggtgcagaagcctggggcatcagtgactgtctcctgcaaggccagtggatatatcttcacaaaatatggtatgaattgggtgcgacaggcccccggacaagggcttgagtgggtggggtgggtcagcggctttgacggtaaggcacagtatgcaccgaagatgaagggcagagtcacgattaccacggacacccccacgaacacagtctacatgcaactgacgagcctgagagctgacgacacggccgtctattactgtgcgagaattgttttctgtcatcgtactatttgatggctctatggactggacttcgtc

SEQ ID NO: 458935 - DNA, 497 bp, Homo sapiens
  misc_feature: HEFZJCU01CWIUT.4.18.B07.1.454.heavy.3.raw
agcactgtagcacgaccggtgctcgatttagtcgctgcgtaagggggagcatcacccagcaaccacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagttcagggcagggtcaccatgaccagggacacgtccttcagcacagcctacttggaggtgagcaggctgagatctgacgacacggccgtgtattactgtgcgagagaggaagacttgagtcggatacagctgtggttaagagta

SEQ ID NO: 458936 - DNA, 482 bp, Homo sapiens
  misc_feature: HEFZJCU01EQIYU.10.35.D02.1.454.heavy.3.raw
catagtagtgcacgaccggtgctcgatttagcacacgatagttgggtttgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctggaaagcgatgacacaggactctattattgtaccactaagagtcccacgaagactgtgggaagggactgctggggccagggagcccttgtcaccgtctcctcagcctccaccaagggcccatcggtcttcccctggcgccctgctccaggagcacctccgagagcacagcggccctgggctgcctggtcaaggactactcccactactatg

SEQ ID NO: 458937 - DNA, 494 bp, Homo sapiens
  misc_feature: HEFZJCU01CTP2T.14.25.C03.1.454.heavy.3.raw
cgtctagtaccacgaccggtgctcgatttagtagtgtagatttgggtttgggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaaacagcctgagagctgaggacacggctgtgtattactgtgggagagatggaggtcgatattgt

SEQ ID NO: 458938 - DNA, 523 bp, Homo sapiens
  misc_feature: HEFZJCU01CBTE7.10.85.H08.1.454.heavy.3.raw
catagtagtgcacgaccggtgctcgatttagtatcactcagtcgcgggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccaggggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccgggctatggttcgggacctctgggggccagggtaacccg

SEQ ID NO: 458939 - DNA, 508 bp, Homo sapiens
  misc_feature: HEFZJCU01D84FU.53.19.B08.1.454.heavy.3.raw
cgcgtatacacacgaccggtgctcgatttagtgagtcagtaaggggtctgggagacgagcccagcactggaagtcgccggtgtttccattcggtgatcatcactgaacacagaggactcaccatggagtttgggctgacctgggttttcttcgttgctcttttaagaggtgtccagtgtcaggtgcagctggtggagtcggggggaggcgtggtccagcctgggaagtccctgagactctcctgtgcggcctctggattcagtttcagttggtacggcatgcactgggtccgtcaggctccaggcaaggggctggagtgggtggcaattatatcgtatgatggaaccaaaagaactacgcagactccgtgaagggccgcttcagtatctccagagacgatcgccgggacaccctttatttgcaaatgagcagcctgagagttggagacacggctgtatattactgtgcgagagacaaacctgaatatagcactggctggcagggcctt

SEQ ID NO: 458940 - DNA, 372 bp, Homo sapiens; identical to SEQ ID NO: 444727
  misc_feature: HEFZJCU01D0HUC.3.42.D09.1.454.heavy.3.raw

SEQ ID NO: 458941 - DNA, 516 bp, Homo sapiens
  misc_feature: HEFZJCU01CHN0G.51.62.F07.1.454.heavy.3.raw
cgatcgtatacacgaccggtgctcgatttagtagtcgcataaagggaaaggggaaccagattcctcctctaaagaagcccctgggagcacagttcatcaccatggactggacctggaagttcctctttgtggtggcagcagcaacaggtgtccagtcgcaggtccagctggtgcagtctgggactgaggtgaagaggcctgggtcctcgatgaaggtctcctgcaaggcatctaaaaacatcttaagaagttatgacatcgcctgggtgcgacaggcccctggacatgggcttgagtgggtgggcaggatcatccctatgtttggagtcgcaaactacgcacagaagttccgggcaaagtcacgttgaccgcggacacagtcacggacacagcctacatggaactcaacggcctcagatttgaggacacggccgtctattattgtgcgagagtgagaaattcggtggctactcccttgactactggggccagggaaccctggtccaccgtctcctc

SEQ ID NO: 458942 - DNA, 496 bp, Homo sapiens
  misc_feature: HEFZJCU01C5U77.40.23.C01.1.454.heavy.3.raw
tctagcgactcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggctattttaaaaggtgtccaatgtgaagtgcagctggtggagtctgggggaggcttggtgcagcctggcaggtccctgagactctcctgtgcagcctctggattcacttttggtgattatgccatgcactgggtccggcaagctccagggaagggcctggagtgggtctcaggtattagttggaatagtggaagtattgactatggggactctgtgaagggccgattcaccatctccagagacaacgccaagaactccctgtatctgcaaatgagcagtctgagagctgaggacacggccttgtattactgtgcaaagatactagggaat

SEQ ID NO: 458943 - DNA, 519 bp, Homo sapiens
  misc_feature: HEFZJCU01A0BGO.4.35.D02.1.454.heavy.3.raw
agcactgtagcacgaccggtgctcgatttagcacacgatagttgggtttggggactttctgagagtcctggacctcctgagcaagaacatgaaacatctgtggttcttccttctcctggtggcagctcccagatgggtcctgtcccaggtgcggctgcaggagtcgggcccaggactggttaagccttcggagaccctgtccctcacctgcagtgtgactggtggctccatcagtaatttgtactggagctggatccggcagtcccaagggaagggactggagtgggttggatatatctttcacaccgggaccaccaactacaatccctccctcaagagtcgactcaccatgtcactggacacttccaagaaccagttctccctaaaattgacctctgtgagcgctgcagacacggccgtctattactgtgcgagactgcggggctattatggttcgggagatcccagtggttttgatatatggggccaggggacagcggtcaccgtctctcagcctcc

SEQ ID NO: 458944 - DNA, 381 bp, Homo sapiens
  misc_feature: HEFZJCU01A9S3V.47.77.G11.1.454.heavy.3.raw
agctcacgtacacgaccggtgctcgatttagctagtcactcaagggaaaggggctggagtgggtctcaggcattggtggtagtggtgccaggacacattacgtaaaggtccctgcagggccgattctttatctccagagacaattccaggaacatactgattctgcacgttgaccagactgagagtcgaggacacggccggtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggcaaggactacttcctacgtgagct

SEQ ID NO: 458945 - DNA, 521 bp, Homo sapiens
  misc_feature: HEFZJCU01CYFMD.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaggtaaaagtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtattc

SEQ ID NO: 458946 - DNA, 515 bp, Homo sapiens
  misc_feature: HEFZJCU01BVV3R.4.39.D06.1.454.heavy.3.raw
agcactgtagcacgaccggtgctcgatttagtgacatctcgcagttctttgggttttggggggaagtgtggtacggcctggggggtccctgagactctcctgtacagcctctggattctcctttgatgattatggcatgagctgggtccgccaagctccagggaaggggctggagtgggtgtctggtatgaattggagtggcggtagtacagcttatgcagactctgtgaagggccgattcaccatctccagagacaacgccaagaactccctgtatctgcaattgaacagtctgagagccgaggacacggccttgtattactgtgcgagaacatttagggtgtgtagtggtaacagctgctattcgtcgactgggtttgactactggggccagggagccctggtcaccgtctcctcagcctccaccaagggcccatcggtcttcccctggcgccctgctccaggagcacctccgagagcacagccggcccgtgggctgcctggtcaaggactta

SEQ ID NO: 458947 - DNA, 516 bp, Homo sapiens; identical to SEQ ID NO: 447339
  misc_feature: HEFZJCU01CUDZR.46.67.G01.1.454.heavy.3.raw

SEQ ID NO: 458948 - DNA, 529 bp, Homo sapiens
  misc_feature: HEFZJCU01A1524.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccacctccaaccg

SEQ ID NO: 458949 - DNA, 508 bp, Homo sapiens
  misc_feature: HEFZJCU01B9QC0.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgttttggccgtgaactactggggccagggcaccctggtcaccgtctcctcagcttccaccaagggcccatcggtcttcccctggcgccctgctccaggagcacctctgggggcacagcgccctgggctgcctggtcaaggactacttcccata

SEQ ID NO: 458950 - DNA, 491 bp, Homo sapiens; identical to SEQ ID NO: 446104
  misc_feature: HEFZJCU01AGO94.3.34.D01.1.454.heavy.3.raw

SEQ ID NO: 458951 - DNA, 497 bp, Homo sapiens
  misc_feature: HEFZJCU01DXA1F.51.3.A03.1.454.heavy.3.raw
cgatcgtatacacgaccggtgctcgatttagagagcgtcacaggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaagggttcctgcatggtttctggatattccctgactagtcatgctatgcattgggtgcgccaggcccccggacaaagctttgagtggatgggatggatcaccgctggcaatggtgacacaaaatattcacagaagttccagggcagagtcaccattaacagggacacatctgcgagtacaggctacatggaactgagcggcctgagatctgaggacacggctatttattactgtgcgagagggaagtgggatattgtggcagctccaggtgcccagccggccccttacg

SEQ ID NO: 458952 - DNA, 400 bp, Homo sapiens
  misc_feature: HEFZJCU01DDYD7.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggctgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 458953 - DNA, 524 bp, Homo sapiens; identical to SEQ ID NO: 445902
  misc_feature: HEFZJCU01BYPXP.9.78.H01.1.454.heavy.3.raw

SEQ ID NO: 458954 - DNA, 484 bp, Homo sapiens
  misc_feature: HEFZJCU01D02HG.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgccctgctccaggagcacctccgaggagcacagccggccctcggggctgcctggtcaaggactacttccacgcgtatgt

SEQ ID NO: 458955 - DNA, 533 bp, Homo sapiens
  misc_feature: HEFZJCU01EX7G1.17.28.C06.1.454.heavy.3.raw
cgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatgtggaaaaagtaatggctgtgtttattggggccaggggagccctggtcaccgt

SEQ ID NO: 458956 - DNA, 515 bp, Homo sapiens
  misc_feature: HEFZJCU01DUDPJ.40.81.H04.1.454.heavy.3.raw
  modified_base (476)..(476): a, c, t, g, unknown or other
tctagcgactcacgaccggtgctcgatttagtagtgtagattcgcggggacacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccggcggggctgaccnctgggggccaggggaaccctgggtccacccggttctccc

SEQ ID NO: 458957 - DNA, 484 bp, Homo sapiens; identical to SEQ ID NO: 452752
  misc_feature: HEFZJCU01C1CUP.11.23.C01.1.454.heavy.3.raw

SEQ ID NO: 458958 - DNA, 508 bp, Homo sapiens
  misc_feature: HEFZJCU01AQTIQ.8.34.D01.1.454.heavy.3.raw
ctcgcgtgtccacgaccggtgctcgatttagatcgtctgtgttgagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggagggggaaccgagcgggagttccagtactcctt

SEQ ID NO: 458959 - DNA, 512 bp, Homo sapiens
  misc_feature: HEFZJCU01A2YIH.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcggctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggaactctggtcaccgtctccgcagcctccaccaggccc

SEQ ID NO: 458960 - DNA, 510 bp, Homo sapiens
  misc_feature: HEFZJCU01CVKIT.17.31.C09.1.454.heavy.3.raw
cgtagactagcacgaccggtgctcgatttagacgtctcatcaaggaaggaagggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaagcccggggagtctctgaggatctcctgtaagggttctggatacaggttttccagctactggatcacctgggtgcgccagaagcccggtaaaggcctggagtggatggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtctc

SEQ ID NO: 458961 - DNA, 400 bp, Homo sapiens; identical to SEQ ID NO: 444452
  misc_feature: HEFZJCU01CHB4L.47.24.C02.1.454.heavy.3.raw

SEQ ID NO: 458962 - DNA, 503 bp, Homo sapiens
  misc_feature: HEFZJCU01AMB20.11.71.G05.1.454.heavy.3.raw
cgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacgggctggtgtattactgtgcgtaaagatttctatagaggttgacgtac

SEQ ID NO: 458963 - DNA, 418 bp, Homo sapiens; identical to SEQ ID NO: 446028
  misc_feature: HEFZJCU01DYYVA.16.28.C06.1.454.heavy.3.raw

SEQ ID NO: 458964 - DNA, 515 bp, Homo sapiens; identical to SEQ ID NO: 454144
  misc_feature: HEFZJCU01DDZ1L.4.57.F02.1.454.heavy.3.raw

SEQ ID NO: 458965 - DNA, 517 bp, Homo sapiens; identical to SEQ ID NO: 451963
  misc_feature: HEFZJCU01DMS1C.26.71.G05.1.454.heavy.3.raw

SEQ ID NO: 458966 - DNA, 481 bp, Homo sapiens
  misc_feature: HEFZJCU01B80EK.7.76.G10.1.454.heavy.3.raw
cgtgtctctacacgaccggtgctcgatttagtcactcatacagggagaggctcttctgtgtgtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccataaaattttatgcggactccgtgaacggtcgattcaccatctccagagacaattccaggaacacactgtttctgcaaatgaacagcctgagaattgaggactcgggtatatactactgtgcccgtgacccctgactgataaaccggactggttcgaccctggggccaggacct

SEQ ID NO: 458967 - DNA, 516 bp, Homo sapiens
  misc_feature: HEFZJCU01B6F62.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctggggcacagcggcctggctgcctggtcaaggactacttcctagagacacg

SEQ ID NO: 458968 - DNA, 554 bp, Homo sapiens
  misc_feature: HEFZJCU01BB704.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccgagggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaaggcaaaacgtccgaagtcgttatcactttgactcctggggccagggaaccctggtcagcgtctcttcagcctccaccaagggcccatcggtccttccccctcggcaccctcctccaagacgcacctcctggggggccacgacgccggccctcggggcctggccttc

SEQ ID NO: 458969 - DNA, 514 bp, Homo sapiens
  misc_feature: HEFZJCU01AITVC.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgtggggccagggtaacccg

SEQ ID NO: 458970 - DNA, 506 bp, Homo sapiens; identical to SEQ ID NO: 446520
  misc_feature: HEFZJCU01COUZE.10.38.D05.1.454.heavy.3.raw

SEQ ID NO: 458971 - DNA, 487 bp, Homo sapiens
  misc_feature: HEFZJCU01CEN3D.47.85.H08.1.454.heavy.3.raw
agctcacgtacacgaccggtgctcgatttagtatcactcagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtcattgtgagcttgactcctggggccagggaaccctggtcatcgtctcctcagcctccaccaagggcccatcggtcttcccctggcgccctgctccaggagcacctccgagagcacagcggccctgggctgcctgtcaaggactactcctacgtgagct

SEQ ID NO: 458972 - DNA, 494 bp, Homo sapiens
  misc_feature: HEFZJCU01BOIEO.14.25.C03.1.454.heavy.3.raw
  modified_base (475)..(475): a, c, t, g, unknown or other
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatcctccagagacaattccaagaacacgcagtatctgcaaatgaacagcctgagagctgaggacacggctgtgttattactgtggganagatggaggtcgatattgt

SEQ ID NO: 458973 - DNA, 397 bp, Homo sapiens
  misc_feature: HEFZJCU01CQEAX.40.28.C06.1.454.heavy.3.raw
tctagcgactcacgaccggtgctcgatttagagctcacgtattgggtttgggtgcccaagctgctggagtggattgggagtatgcactatagtgggagcacccactacaccccgtccctcaagagtcgagtcaccatatccgtagacacgtccaaggaatcagttctcccctgaagctgacctctgtgaccgccggcagacacggctgtttattactgtgtgagacgggtgccccaagaaaaagtgttttatccctgggccagggaaccctggtcaccgtctcctcagcctccaccaagggcccatcggtcttccccctggcaccctcctccaagagcacctctgggggcacagcggccctgggctgcctggtcaaggactacttccagtcgctaga

SEQ ID NO: 458974 - DNA, 499 bp, Homo sapiens
  misc_feature: HEFZJCU01BSW24.13.37.D04.1.454.heavy.3.raw
tcacgtactacacgaccggtgctcgatttagtagcatactgttgggtttggggagctctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtctgggggaggcttggttcagcctggggggtccctgagactctcgtgtgcagcctctggatttagtttagcagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacacgcctggggagccggaggacacggtccgtttatcactgtgcgaaagatattgtaatga

SEQ ID NO: 458975 - DNA, 501 bp, Homo sapiens; identical to SEQ ID NO: 445999
  misc_feature: HEFZJCU01DHIQO.12.38.D05.1.454.heavy.3.raw

SEQ ID NO: 458976 - DNA, 484 bp, Homo sapiens
  misc_feature: HEFZJCU01BTHXP.53.73.G07.1.454.heavy.3.raw
cgcgtatacacacgaccggtgctcgatttagctctacgctcaggggctgaaagcatcatccaacaaccacatcccttctctacagaagcctctgagaggaaagttcttcaccatggactggacctggagggtcttctgcttgctggcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttgagtggatgggtctaatcaaccctagtggtggatctacaagttactcacagagaatgcagggccgaattaccatgaccagagacacgtccacgagtacagtctacatggaggtgagcagcctgagatctgaggacacggccatgtattactgtgcgatcttagtgattacgactacaatt

SEQ ID NO: 458977 - DNA, 518 bp, Homo sapiens; identical to SEQ ID NO: 447436
  misc_feature: HEFZJCU01CP52O.13.76.G10.1.454.heavy.3.raw

SEQ ID NO: 458978 - DNA, 507 bp, Homo sapiens
  misc_feature: HEFZJCU01ESJOJ.51.65.F10.1.454.heavy.3.raw
cgatcgtatacacgaccggtgctcgatttagctacgctctaagggggagcatcacccagcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggattaattccaaaagtggtggcacaaagactgcacagaagtttcagggcagggtcaccatgaccagggacaagtccaccaacacagcctacatggaactaaggggactgacatctgacgacacggccatgtattattgtgcgagagaaatgttaggtactgctttgggtccctggggcccgggaacccgggtc

SEQ ID NO: 458979 - DNA, 510 bp, Homo sapiens
  misc_feature: HEFZJCU01EZG1N.16.71.G05.1.454.heavy.3.raw
tgtactactccacgaccggtgctcgatttagtgtcgtcgcaagagagaggagcccagccctgggattttcaggtgttttcatttggtgatcaggactgaacagagagaactcaccatggagtctgggctgagcgtgcgtttctaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactggggccg

SEQ ID NO: 458980 - DNA, 503 bp, Homo sapiens
  misc_feature: HEFZJCU01ALSWV.40.23.C01.1.454.heavy.3.raw
tctagcgactcacgaccggtgctcgatttagtacacgtgattagggattgggggggagaggagccccagccctgagattcccaggtgtttccattcagtgatcagcactgaacacagaggactcaccatggagttgggactgagctggattttccttttggctattttaaaaggtgtccaatgtgaagtgcagctggtggagtctgggggaggcttggtgcagcctggcaggtccctgagactctcctgtgcagcctctggattcacttttggtgattatgccatgcactgggtccggcaagctccagggaagggcctggagtgggtctcaggtattagttggaatagtggaagtattgactatggggactctgtgaagggccgattcaccatctccagagacaacgccaagaactccctgtatctgcaaatgagcagtctgagagctgaggacacgggccttgtattactgtgcaaagatactaggggaatagtagtgtctc

SEQ ID NO: 458981 - DNA, 507 bp, Homo sapiens
  misc_feature: HEFZJCU01BVC38.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaggcagattcatcatctcaagagatgattcaacggcatcgcctatctgcagatgaacagcctgaagacgaggacacagccgtctattactgtgttagggtagttttacgtattttggt

SEQ ID NO: 458982 - DNA, 524 bp, Homo sapiens
  misc_feature: HEFZJCU01DBIPQ.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttgggccagggaaccctggtccaccgtctcctcagcctccaccaagggcccatcggtcttcccctggcgccctgctccaggagcacctccgagagcacagcggcctcgggctgcctggtcaggactacttcca

SEQ ID NO: 458983 - DNA, 415 bp, Homo sapiens; identical to SEQ ID NO: 444794
  misc_feature: HEFZJCU01AN6Y8.14.74.G08.1.454.heavy.3.raw

SEQ ID NO: 458984 - DNA, 379 bp, Homo sapiens
  misc_feature: HEFZJCU01CQJFS.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccggggaaccctggtcaccgtctcttcagcttccaccaagggcccatcggtcttccccctggcgccctgctccaggagcacctctgggggcacagcggccctgggctgcctggtcaaggactacttcctacctgagct

SEQ ID NO: 458985 - DNA, 534 bp, Homo sapiens
  misc_feature: HEFZJCU01AO1M4.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacactccctgaaagcgtcaactactactactacggtatggacctctgggaccg

SEQ ID NO: 458986 - DNA, 511 bp, Homo sapiens; identical to SEQ ID NO: 451481
  misc_feature: HEFZJCU01DF007.13.76.G10.1.454.heavy.3.raw

SEQ ID NO: 458987 - DNA, 524 bp, Homo sapiens
  misc_feature: HEFZJCU01ELO82.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtccttccccctggccg

SEQ ID NO: 458988 - DNA, 539 bp, Homo sapiens
  misc_feature: HEFZJCU01EXJ8U.22.34.D01.1.454.heavy.3.raw
acatacgcgtcacgaccggtgctcgatttagatcgtctgtgttgggtttggggggaagaggaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagagtcgagccaccatatcagtcgacacgtccaagaaccagttctccctgaaactgaggtctgtgaccgcagcggacacggccgtgtattactgtgcgagagagtccgggtccgatatctggccgttcgacccctggggccagggaaccctggtcaccgtctcctcagcctccaccaagggcccatcggtcttccccctggcgccctgctccaggagcacctccgagagcacagcggccctgggctgcctggtcaaggactactccacg

SEQ ID NO: 458989 - DNA, 484 bp, Homo sapiens; identical to SEQ ID NO: 449584
  misc_feature: HEFZJCU01EQF06.10.35.D02.1.454.heavy.3.raw

SEQ ID NO: 458990 - DNA, 524 bp, Homo sapiens
  misc_feature: HEFZJCU01DQ8ZN.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatccggtcttccccctggcg

SEQ ID NO: 458991 - DNA, 513 bp, Homo sapiens
  misc_feature: HEFZJCU01C0JXL.48.19.B08.1.454.heavy.3.raw
agtatacatacacgaccggtgctcgatttagtgagtcagtaagggggctttctgagagtcatggatctcatgtgcaagaaaatgaagcacctgtggttcttcctcctcctggtggcggctcccagatgggtcctgtcccagctgcagctgcaggagtcgggcccaggactggtgaagccttcggagaccctgtccctcacctgcactgtctctggtgactccatcagcagtagtacttactactggggctggatccgccagcccccagggaaggggctggagtggattgggagtatctattatagtgggagtacctactacaacccgtccctcaagagtcgactcaccatatccgtagacacgtccaagaaccagttctccctgaagctgagctctgtgaccgccgcagacacggctgtgtattactgtgcgagggggccgggatattgttatagaaccacctgctatctgagctggttcgactgctggggccaggggaaccctggtctaccg

SEQ ID NO: 458992 - DNA, 513 bp, Homo sapiens
  misc_feature: HEFZJCU01EWQ7F.51.43.D10.1.454.heavy.3.raw
cgatcgtatacacgaccggtgctcgatttagactagcagtaagggggagcatcacccagttcaaccacatctgtcctccagagaatcccctgagagctccgttcctcaccatggagtggacctggaggatcctcttcttggtggcagcagccacaggagtccactcccaggtgcagttggtgcagtctggggctgaagtgaggaagcctggggcctcagtgagggtctcctgtaaggcctctggatacatcttcaccgaccacaacatgcactgggtgcgacaggcccctggacaagggcttgagtggatgggctggataattccaaaagtggtggcacaaagactgcacagaagtttcagggcagggtcaccatgaccagggacaagtccaccaacacagcctacatggaactaaggggactgacatctgacgacacggccatgtattattgtgcgagagaaatgttaggtactgtctttgggtcccttgggggccccgggaacccggggtc

SEQ ID NO: 458993 - DNA, 519 bp, Homo sapiens; identical to SEQ ID NO: 444867
  misc_feature: HEFZJCU01AE4HB.9.34.D01.1.454.heavy.3.raw

SEQ ID NO: 458994 - DNA, 518 bp, Homo sapiens
  misc_feature: HEFZJCU01DH6T1.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctggggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaggactactccagacgtatca

SEQ ID NO: 458995 - DNA, 523 bp, Homo sapiens
  misc_feature: HEFZJCU01C0C3Y.15.16.B05.1.454.heavy.3.raw
tctacgtagccacgaccggtgctcgatttagagctcacgtattgggctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggcccatcggtcttcccctggcgccctgctccaggagcacctccgagagcacagcggcctgggctgcctggtcaaggactacttccg

SEQ ID NO: 458996 - DNA, 530 bp, Homo sapiens; identical to SEQ ID NO: 456319
  misc_feature: HEFZJCU01EN5JC.18.33.C11.1.454.heavy.3.raw

SEQ ID NO: 458997 - DNA, 522 bp, Homo sapiens
  misc_feature: HEFZJCU01CAEIT.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacattttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaaggccatcggtcttcccctggcgccctgctccaggagcacctccgagagcacagcggccctgggctgcctggtcaaggactactcc

SEQ ID NO: 458998 - DNA, 509 bp, Homo sapiens
  misc_feature: HEFZJCU01AHOHP.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgtttcatctgaaggagtgttcaatactatacagactccgtgaagggccgattcaccatctccagagacaattccaagaacacgatgtatctgcaaatggacagcctaagagttgaggacacggctgtttattactgtacgaaaggaggggggagtacagtggcagctccaagtacttacg

SEQ ID NO: 458999 - DNA, 491 bp, Homo sapiens; identical to SEQ ID NO: 444592
  misc_feature: HEFZJCU01C50S9.11.26.C04.1.454.heavy.3.raw

SEQ ID NO: 459000 - DNA, 495 bp, Homo sapiens
  misc_feature: HEFZJCU01CECV5.51.38.D05.1.454.heavy.3.raw
cgatcgtatacacgaccggtgctcgatttagtatctgatagttgggtttgggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttcccctggcaccctcctccaagagcacctctgggggcacagcggccctgggctgcctggtcaaggactacttcctcgtagcact

SEQ ID NO: 459001 - DNA, 515 bp, Homo sapiens
  misc_feature: HEFZJCU01CTIOY.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttcccctggcaccctcctccaagagcacctctgggggc

SEQ ID NO: 459002 - DNA, 525 bp, Homo sapiens
  misc_feature: HEFZJCU01CJZOR.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactataccgactccgtgaagggccgattcaccatctccagagacaattccaagaacacgatgtatctgcaaatggacagcctaagagttgaggacacggctgtttattactgtacgaaagagggggatacagtggcagctccaagtactactttgacttctggggccagggaaccctggtcaccgtctcctcagcctccaccaagggcccatcggtcttcccctggcgccctgctccaggagcacctccgacg

SEQ ID NO: 459003 - DNA, 315 bp, Homo sapiens; identical to SEQ ID NO: 444422
  misc_feature: HEFZJCU01AX5CO.47.84.H07.1.454.heavy.3.raw

SEQ ID NO: 459004 - DNA, 471 bp, Homo sapiens; identical to SEQ ID NO: 444988
  misc_feature: HEFZJCU01B1AED.48.1.A01.1.454.heavy.3.raw

SEQ ID NO: 459005 - DNA, 500 bp, Homo sapiens; identical to SEQ ID NO: 445807
  misc_feature: HEFZJCU01CSDMX.40.81.H04.1.454.heavy.3.raw

SEQ ID NO: 459006 - DNA, 541 bp, Homo sapiens
  misc_feature: HEFZJCU01CIDNE.15.86.H09.1.454.heavy.3.raw
tctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcacccgtgaaaggaagattcaccatctcaagagataattcaaaaacgacggtgtatttgcaaatgaacagcctgaaaaccgaggacacagccgtctattactgtaccacagattcggaagtgcatcgacgtaaaggaggctatgcttttgatatctgggcccagggac

SEQ ID NO: 459007 - DNA, 499 bp, Homo sapiens
  misc_feature: HEFZJCU01DPS7B.40.22.B11.1.454.heavy.3.raw
tctagcgactcacgaccggtgctcgatttagacgacagctcaggggggtgatcagcactgaacacagaggactcaccatggagttggggctgtgctgggttttccttgttgctattttagaaggtgtccagtgtgaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtatattactgtgcgagagagccgaggtggctacaattggagatactactactactacgtatggacgtctggggccaagggaccacggt

SEQ ID NO: 459008 - DNA, 371 bp, Homo sapiens; identical to SEQ ID NO: 444919
  misc_feature: HEFZJCU01D123C.3.1.A01.1.454.heavy.3.raw

SEQ ID NO: 459009 - DNA, 312 bp, Homo sapiens; identical to SEQ ID NO: 448012
  misc_feature: HEFZJCU01CU9OT.49.8.A08.1.454.heavy.3.raw

SEQ ID NO: 459010 - DNA, 370 bp, Homo sapiens
  misc_feature: HEFZJCU01CXURX.3.1.A01.1.454.heavy.3.raw
agacgcactccacgaccggtgctcgatttagacgtctcatccatcagtagtactagtagtaacatatactacgaagactcagtgaagggccgattcaccatctccagagacaaagccaagaactcactgtatctggaaatgaacagcctgagagccgaggacacggctgtgtattactgtgcgagaggcggctttggggttcaggaccgtcctacgctatggacgtctggggccaagggaccacggtcaccgtctcctcagcctccaccaagggcccatcggtcttccccctggcgccctgctccaggagcacctccgagagcacagcggccctgggctgcctggtcaaggactacttccgagtgcgtct

SEQ ID NO: 459011 - DNA, 483 bp, Homo sapiens; identical to SEQ ID NO: 444924
  misc_feature: HEFZJCU01BNDGI.10.35.D02.1.454.heavy.3.raw

SEQ ID NO: 459012 - DNA, 518 bp, Homo sapiens; identical to SEQ ID NO: 444718
  misc_feature: HEFZJCU01E0LZ5.9.34.D01.1.454.heavy.3.raw

SEQ ID NO: 459013 - DNA, 502 bp, Homo sapiens; identical to SEQ ID NO: 450016
  misc_feature: HEFZJCU01EQ18A.17.10.A10.1.454.heavy.3.raw

SEQ ID NO: 459014 - DNA, 496 bp, Homo sapiens
  misc_feature: HEFZJCU01CLL08.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaagggctggaatggatttcatacattagcagtagtggtgcgaccatatactacgcagactctgtgaagggccgattcatcatctccagagacaatggcaacaactcactgtatctggaaatcaacagcctgagagtcgaggacacggctgtatattattgtgcgagagcccctacggtgacg

SEQ ID NO: 459015 - DNA, 519 bp, Homo sapiens
  misc_feature: HEFZJCU01EDAFH.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgatttcaccatctccagagacaattccaagaacacgctgtttcttcaaatgaacagcctgagagccgatgacacggccgtgtattactgtgcgagagatggggcccacgaacgttactacgctatggacgtctggggccaagggaccg

SEQ ID NO: 459016 - DNA, 540 bp, Homo sapiens
  misc_feature: HEFZJCU01DIXB4.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggtaggggccgtttcatgtctggggccaagggacgctggtcaccgtctcttcagcctccaccaagggcccactcggtcttcccctggcaccctcctccaagagcacctctgggggcacagcc

SEQ ID NO: 459017 - DNA, 508 bp, Homo sapiens
  misc_feature: HEFZJCU01AD8YO.4.33.C11.1.454.heavy.3.raw
agcactgtagcacgaccggtgctcgatttagagtgagctcgttgggtttgggggagtgtgaggggacatgagtggtagaaacagtggatatgtgtggcagtgtctgaccttggtgttttttgtttgtaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgcctatctgcagatgaacagcctgaagaccgaggacacagccgtctattactgtgttagggagttttacgatttttggagtggataattataaacccccacttttgactactggggccagggaaccct

SEQ ID NO: 459018 - DNA, 494 bp, Homo sapiens; identical to SEQ ID NO: 447319
  misc_feature: HEFZJCU01A0AF7.4.21.B10.1.454.heavy.3.raw

SEQ ID NO: 459019 - DNA, 390 bp, Homo sapiens; identical to SEQ ID NO: 444541
  misc_feature: HEFZJCU01DWF92.16.24.C02.1.454.heavy.3.raw

SEQ ID NO: 459020 - DNA, 482 bp, Homo sapiens; identical to SEQ ID NO: 452533
  misc_feature: HEFZJCU01ASG3J.19.53.E09.1.454.heavy.3.raw

SEQ ID NO: 459021 - DNA, 500 bp, Homo sapiens
  misc_feature: HEFZJCU01EFHWO.47.48.E04.1.454.heavy.3.raw
  modified_base (475)..(475): a, c, t, g, unknown or other
agctcacgtacacgaccggtgctcgatttagagagcgtcacagagagaaggggctcagagaggagccttagccctggactccaaggcctttccacttggtgatcagcactgagcacagaggactcaccatggaattggggctgagcgtgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccagggaaggggctggagtgggttggcaacataaatccagatggaagtcagaaaacctatgtggactctctgaagggccgattcaccatctccagagacaattcccagaacacggtctatctgcacctgaccagcctgagaactgacgacacgtctctctactactgtncgagagagttgacgagtcatttgtg

SEQ ID NO: 459022 - DNA, 499 bp, Homo sapiens
  misc_feature: HEFZJCU01ENJ9U.53.80.H03.1.454.heavy.3.raw
cgcgtatacacacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtacagtctggggctgaaatgaagaagcctggggcctcagtgaagatctcctgcaaggcttctggattcaccttcaccgcctactatatacattgggtgcgacaggcccctggacaagggcttgactacatgggatggatcaaccctaccagtggtggcacaaagtttgcgcagaagtttcagggcagggtcaccatgaccagggacacgtccatcagcactgcctacatggagctgaccaggctgaaatttgaggacacggccatttattactgtgcaaggaacagcataatgactcgtcccccggactttacg

SEQ ID NO: 459023 - DNA, 497 bp, Homo sapiens; identical to SEQ ID NO: 450948
  misc_feature: HEFZJCU01CMPKD.53.80.H03.1.454.heavy.3.raw

SEQ ID NO: 459024 - DNA, 532 bp, Homo sapiens
  misc_feature: HEFZJCU01EPPUR.17.34.D01.1.454.heavy.3.raw
cgtagactagcacgaccggtgctcgatttagatcgtctgtgttgggtttggggatcacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgtacttctggggccatcggaaccccggtaccg

SEQ ID NO: 459025 - DNA, 502 bp, Homo sapiens
  misc_feature: HEFZJCU01DJYS6.48.59.F04.1.454.heavy.3.raw
agtatacatacacgaccggtgctcgatttagtacacacacttagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtgggccaagggacaatggtcaccgt

SEQ ID NO: 459026 - DNA, 394 bp, Homo sapiens; identical to SEQ ID NO: 444701
  misc_feature: HEFZJCU01A0YIH.3.12.B01.1.454.heavy.3.raw

SEQ ID NO: 459027 - DNA, 528 bp, Homo sapiens
  misc_feature: HEFZJCU01DFB1J.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggccggggaaccctggtcaccgtctccccaccctccaccg

SEQ ID NO: 459028 - DNA, 500 bp, Homo sapiens
  misc_feature: HEFZJCU01EWOJV.19.1.A01.1.454.heavy.3.raw
tactctcgtgcacgaccggtgctcgatttagacgtctcatcaggggaacaaccacattcctcctctaaagaagcccctgggagcacagctcatcaccatggactggacctggaggttcctctttgcggtggcagcagctacaggtgtccagtcccaggtgcagctggtgcagtctggggctgaggtgaggaagcctgggtcctcggtgaaagtttcctgcaaggcttctggggacaccttcacctcctattctatcaactgggtgcgacaagcccctggacaagggcttgagtggatgggaggaagcatccctttctttgatactccagactacgcacagaagttccaggcagagtcacgattaccgcggacgaatccacgagcacagtctatatggaattgaccagcctgacatcagaggacacggccgtcttatttttgtgcgacagaaagagattccatactcgagggcggggcactatggcagcagctgatacggt

SEQ ID NO: 459029 - DNA, 481 bp, Homo sapiens; identical to SEQ ID NO: 445006
  misc_feature: HEFZJCU01EXMN0.7.10.A10.1.454.heavy.3.raw

SEQ ID NO: 459030 - DNA, 506 bp, Homo sapiens; identical to SEQ ID NO: 444674
  misc_feature: HEFZJCU01C4F9M.12.33.C11.1.454.heavy.3.raw

SEQ ID NO: 459031 - DNA, 506 bp, Homo sapiens
  misc_feature: HEFZJCU01CVOAL.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctgcgccctgctccaggagcacctccgagagcacagcggccc

SEQ ID NO: 459032 - DNA, 532 bp, Homo sapiens
  misc_feature: HEFZJCU01D6IAF.18.59.F04.1.454.heavy.3.raw
tacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaccaaaactgatggtggacaacagactacgctgcacccgtgaaaggcagattcaccatctcaagagatgattcaaaagcacgctgtatctgcaaatgaacagcctgagaaccgaggacacagccgtgtattactgtaccacactccctagaaacgcgtacaactactactactactgtatcggacctcgtc

SEQ ID NO: 459033 - DNA, 467 bp, Homo sapiens; identical to SEQ ID NO: 445004
  misc_feature: HEFZJCU01A0915.16.78.H01.1.454.heavy.3.raw

SEQ ID NO: 459034 - DNA, 391 bp, Homo sapiens
  misc_feature: HEFZJCU01AMBMK.51.72.G06.1.454.heavy.3.raw
cgatcgtatacacgaccggtgctcgatttagctacgactgcaagggaaaggggctggagtgggtggcagttatatcatatgatggaaagaataaatactatggagactccgtgaagggccgattcaccatctctagagacaatctcaaggagacagtgcatctgcaaatgaacagcctgagaggtgacgacacggctgtgtattactgtcacctcgagagcagcaattggagagaggtttttgatatctggggccaagggactatggtcaccgtctcttcagcctccaccaagggcccatcggtcttccccctggcaccctcctccaagagcacctctgggggcacagcggccctgagctgcctggtcaaggactacttcctcgtagcact

SEQ ID NO: 459035 - DNA, 395 bp, Homo sapiens
  misc_feature: HEFZJCU01CSRLF.13.60.F05.1.454.heavy.3.raw
tcacgtactacacgaccggtgctcgatttagtacgtcatcagggaaaggggctggagtggattggccgtattaaaagtgagcctgatggtgggacaacagactacgctgcacccgtgaagggcagattcaccatctccagagatgattcaaggaacacagtgtttctgcaaatgaacagcctgactgccggggacactgccgtgtattactgtgccagcagcagtacctggccactatatttttttgacttctggggccagggaaccctggccaccgtctcctcagcttccaccaagggcccatcggtcttccccctggcgccctgctccaggagcacctctgggggcacagcggccctgggctgcctggtcaaggactacttcctagtacgtga

SEQ ID NO: 459036 - DNA, 514 bp, Homo sapiens
  misc_feature: HEFZJCU01D46EV.12.55.E11.1.454.heavy.3.raw
  modified_base (492)..(492): a, c, t, g, unknown or other
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttcccctggcgccctgctccaggagcncctcgtggggcacagcggcccg

SEQ ID NO: 459037 - DNA, 501 bp, Homo sapiens
  misc_feature: HEFZJCU01ADUG2.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctgggccagggaaccctggtcaccgtctcctcagcctccaccaagggcccatcggtcttcccctggcaccctcctccaagagcacctctggggcacagcgccctgggctgctggtcagactacttccgta

SEQ ID NO: 459038 - DNA, 512 bp, Homo sapiens
  misc_feature: HEFZJCU01D5885.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctggggccagggaaccctggtcaccgtctcctcagcctccaccaagggcccatcggtcttcccctggccaccctcctccaagagcacctctgggggcacagcggccctgggctgcctggtcaaggactacttccgtacta

SEQ ID NO: 459039 - DNA, 497 bp, Homo sapiens
  misc_feature: HEFZJCU01B9BON.51.3.A03.1.454.heavy.3.raw
cgatcgtatacacgaccggtgctcgatttagagagcgtcacaggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaagctttgagtggatgggatggatcaccgctggcaatggtgacacaaaatattcacagaagttccagggcagagtcaccattaacagggacacatctgcgagtacatgctacatggaactgagcggcctgagatctgaggacacgggctaagtttattactgtgtcgagaggggaagtggggatattgtggcaggctccaggtcgcccagccggt

SEQ ID NO: 459040 - DNA, 513 bp, Homo sapiens
  misc_feature: HEFZJCU01D02AZ.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggacaatggtcaccgtctcttcagcctccaccaaggcccatcggtcttcccctggcacctcctccaagacgcacctctggggcacagcggcccg

SEQ ID NO: 459041 - DNA, 379 bp, Homo sapiens; identical to SEQ ID NO: 444773
  misc_feature: HEFZJCU01A3XR6.3.59.F04.1.454.heavy.3.raw

SEQ ID NO: 459042 - DNA, 385 bp, Homo sapiens; identical to SEQ ID NO: 444438
  misc_feature: HEFZJCU01EZJW0.18.60.F05.1.454.heavy.3.raw

SEQ ID NO: 459043 - DNA, 502 bp, Homo sapiens
  misc_feature: HEFZJCU01DLL2N.53.33.C11.1.454.heavy.3.raw
cgcgtatacacacgaccggtgctcgatttagagtgagctcgttgggtttgggctgagctgggttttcctcgttgctcttttaagaggtgtccagtgtcacgtgcagctggtgcagtctgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgaccccgtggggccagggaaccctggtcaccgtctcctcagcttccaccaaggccatcggtcttcccctgcg

SEQ ID NO: 459044 - DNA, 485 bp, Homo sapiens
  misc_feature: HEFZJCU01BKQ4C.40.83.H06.1.454.heavy.3.raw
tctagcgactcacgaccggtgctcgatttagatcacgtgcgtcgcggggagctctgggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtctgggggaggcgtggtccagcctgggaggtcactgagactctcctgtgcatcgtccggattcaccttccataaatataacatgcactgggtccgccaggctccaggcaagggactgcagtggctggccactgtctggtcggatgaaagttatgcatactatgcagactctctggaggggccgattcatcatctctagagacaattcgaagaacgacggtcttatctgacaaatgaacagcctgacagtcgaggacacggctagtatatttcgtgtgcgaat

SEQ ID NO: 459045 - DNA, 515 bp, Homo sapiens
  misc_feature: HEFZJCU01BW77Q.22.11.A11.1.454.heavy.3.raw
acatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccgcgggggtcgacccaaattgactactggggccagggaaccctggtcaccgtctcctcagcctccaccaagggcccatcggtcttcccctggccg

SEQ ID NO: 459046 - DNA, 515 bp, Homo sapiens
  misc_feature: HEFZJCU01EJUZS.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagaccctccgatagcagtggctggtccactaggtttgactactgggggccaggggaagcttggtcaccgtctcct

SEQ ID NO: 459047 - DNA, 510 bp, Homo sapiens
  misc_feature: HEFZJCU01BY7WB.47.55.E11.1.454.heavy.3.raw
agctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggagcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgtggggccagggaacccgt

SEQ ID NO: 459048 - DNA, 508 bp, Homo sapiens
  misc_feature: HEFZJCU01DESDV.48.59.F04.1.454.heavy.3.raw
agtatacatacacgaccggtgctcgatttagtacacacacttagggattggggggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggcttttgatgcctttgatatgtggggccagggacaatggtcaccgtctcttcagcctccaccaacggg

SEQ ID NO: 459049 - DNA, 528 bp, Homo sapiens
  misc_feature: HEFZJCU01EUJVS.4.66.F11.1.454.heavy.3.raw
agcactgtagcacgaccggtgctcgatttagtcacgcgagaagggggggagaggagccccagccttgggattcccaagtgttttcattcagtgatcaggactgaacacagaggactcaccatggagtttgggctgagctggattttccttactgctattttaaaaggtgtccagtgtgaggtgaaactggtggagtctgggggaggcttgataaagcctggggggtcccttagactctcctgtgcagcctctggattcaccttcagtgacgactggatgaattggatccgccaggctccagggaaggggctggagtgggtcggccatattaagcccaaaactgaacgtggggaaacagactacgctgcacccgtgagaggcagattcaccatttcaagagatgattcaaaaagtacactgtatctggaaatgaacagcctgagaatcgacgacacagccgtttattactgcagagagggcactatggtccctggggccagggaaccctgggtccaccgtctcctcacg

SEQ ID NO: 459050 - DNA, 503 bp, Homo sapiens
  misc_feature: HEFZJCU01CUZ9Z.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttccccctggcgccctcgctccaggagcacctccgagagcacagcggccctgggctgcctggtcaaggactacttcctatgtatact

SEQ ID NO: 459051 - DNA, 424 bp, Homo sapiens
  misc_feature: HEFZJCU01BJDM9.16.78.H01.1.454.heavy.3.raw
tgtactactccacgaccggtgctcgatttagtgtgagtagtttgggtttgggctcaactctcttgtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttccccctcggcaccctcctccaagagcacctctgggggcacagcggccctgggctgactggtcaaggactacttccgagtagtaca

SEQ ID NO: 459052 - DNA, 534 bp, Homo sapiens
  misc_feature: HEFZJCU01EZBP0.12.12.B01.1.454.heavy.3.raw
atacgacgtacacgaccggtgctcgatttagtagtgtagattccgcgggggctttctgagagtcatggacctcctgtgcaggaacatgaagcacctgtggtttttcctcctgctggtggcagctcccagatggggcctgtcccaggtgcagctgcaggagtcgggcccaggactggtgaagccttcggagaccctgtccctcacctgcgctgtgtccggtttctccatcagtagtgggcattattggggctggatccggcagcccccagggaaggggctggagtggattgggagtatctattttagcgggagcacctaccagaacgcgtccctcaagagtcgaatcaccatgtcggtggacacatcgaagaaccagatctcccttaagttgaggtctgtgaccgccgctgacacggccgtctattactgtgcgagagtccgtgctggaagaacactttttttgacttattggggccagggaatcctggtcaccgtcgcctcagcctccaccaagggcccatcggtcttcccccg

SEQ ID NO: 459053 - DNA, 315 bp, Homo sapiens; identical to SEQ ID NO: 444422
  misc_feature: HEFZJCU01C6JAX.47.84.H07.1.454.heavy.3.raw

SEQ ID NO: 459054 - DNA, 516 bp, Homo sapiens
  misc_feature: HEFZJCU01DXQW1.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattgggggagcgactggttcgacccctggggccagggaaccctggtcaccgtctcctcagcctccaccaacgggcccatcggtccttcccctggccaccctccctccaagagcacctcgtgggggcacagcggcccgtgggctgcctggtcaaggactacttcctacgtcgtat

SEQ ID NO: 459055 - DNA, 513 bp, Homo sapiens
  misc_feature: HEFZJCU01BU9XC.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaaggccatcgtcttcccctggcgcctgctccaggagcacctctgggggcacagccggcccgtgggctcgcctggtcaaggactacttcccactacc

SEQ ID NO: 459056 - DNA, 530 bp, Homo sapiens; identical to SEQ ID NO: 445588
  misc_feature: HEFZJCU01DUFIV.11.85.H08.1.454.heavy.3.raw

SEQ ID NO: 459057 - DNA, 513 bp, Homo sapiens
  misc_feature: HEFZJCU01BKUOY.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccaggggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagccaccggcagttagtcacccatactactttgactactggggaccg

SEQ ID NO: 459058 - DNA, 497 bp, Homo sapiens; identical to SEQ ID NO: 458079
  misc_feature: HEFZJCU01BTBCM.3.26.C04.1.454.heavy.3.raw

SEQ ID NO: 459059 - DNA, 403 bp, Homo sapiens; identical to SEQ ID NO: 444540
  misc_feature: HEFZJCU01C8QA4.16.72.G06.1.454.heavy.3.raw

SEQ ID NO: 459060 - DNA, 512 bp, Homo sapiens; identical to SEQ ID NO: 447906
  misc_feature: HEFZJCU01DF2NZ.17.33.C11.1.454.heavy.3.raw

SEQ ID NO: 459061 - DNA, 498 bp, Homo sapiens
  misc_feature: HEFZJCU01BRRX0.40.81.H04.1.454.heavy.3.raw
tctagcgactcacgaccggtgctcgatttagtagtgtagattcgcgggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccggcggggctggaccactc

SEQ ID NO: 459062 - DNA, 477 bp, Homo sapiens
  misc_feature: HEFZJCU01CQ2HX.3.39.D06.1.454.heavy.3.raw
agacgcactccacgaccggtgctcgatttagtgacatctcgcagttctttgggttttggggggtccctgagactctcatgtacaggctctgagttcagcgtcactaaatactacatgagctgggtccgccaggctccagggaggggactggactgggtctccagtgttaacagcgatggaagtacatattatgcagactccgtgaagggccgattcaccatctccagagacaattccaagaacactctgtatcttcaaatgaacagcctgagagccgaggacacggccttctattactgtgcgagcgatcacgggcggagtctgatactttcttggggccagggaaccctggtcaccgtctcctcagcctccaccaacgggcccatcggtcttccccctggcgccctgctccaggagcacctccgagagcacagcggccctgggctgcctggtcaaggactacttccgagtgcgtct

SEQ ID NO: 459063 - DNA, 521 bp, Homo sapiens
  misc_feature: HEFZJCU01C2WFD.47.78.H01.1.454.heavy.3.raw
agctcacgtacacgaccggtgctcgatttagtgtgagtagtttgggtttggggctctctgagagtcagggacctcctgcattagcacatgaaacacctgtggttcttccgcctcctggtgacagctcccagatttgactgcctcaggaatgccgatttgaagatgtgagatgctgcctctgatcccaggactcactgcgggtttctctgttcacaggggtcctgtcccaggtgcaaccacaccactggggcgcaggactgttgaagccttcggagaccctgtccctcacctgcgctgtctgtggtgggtccttcagtgactactactgagactagatccgccagtccccagggaaggggctggaatggattcgacaggtcaatcattacagatccaccaactacaacccgtccctcagcagtcgagtcacctttcgcttgacacgtaccaacaaccagttttctctgaatcaaacccgagaccgccgcgacagcctcggcccctcggggcccagaaacccc

SEQ ID NO: 459064 - DNA, 479 bp, Homo sapiens
  misc_feature: HEFZJCU01CW1HF.11.63.F08.1.454.heavy.3.raw
cgagagataccacgaccggtgctcgatttagcgatcgtataagggggcatcacccagcaaccacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacaggcccctggacaagggcttgagtggatgggacggatcaaccctaatagtggtggcacaaactatgcacagaagtttgagggcagggtcatcatgaccagggacacgtccatcagcacagcctacatggagctgagcaggctgacatctgacgacacggccgtgtattactgtgcgagagataaaggggattgtgatagta

SEQ ID NO: 459065 - DNA, 535 bp, Homo sapiens; identical to SEQ ID NO: 452787
  misc_feature: HEFZJCU01BW45Z.14.57.F02.1.454.heavy.3.raw

SEQ ID NO: 459066 - DNA, 509 bp, Homo sapiens; identical to SEQ ID NO: 444586
  misc_feature: HEFZJCU01EBKB0.12.78.H01.1.454.heavy.3.raw

SEQ ID NO: 459067 - DNA, 511 bp, Homo sapiens
  misc_feature: HEFZJCU01EQ8WY.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccgggtgagcctacgggcaggcggtccttttgacctttcgtc

SEQ ID NO: 459068 - DNA, 519 bp, Homo sapiens
  misc_feature: HEFZJCU01ANZ25.48.30.C08.1.454.heavy.3.raw
agtatacatacacgaccggtgctcgatttagtctgacgtcaaagggaaagggggggagaggagccccagccttggaattcccaagtgttttcattcagtgatcaggactgaacacagaggactcaccatggagtttgggctgagctggattttccttgctgctattttaaaaggtgtccagtgtgaggtgcagctggtgcagtccgggggggcctggtaccgcctgggggtcccttagactctcctgtgcagcctctggattcatcttcagtaatgtctggatgacctggttccgccaggctccagggaaggggctggagtgggttggccgtgttaaaaccaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccaggg

SEQ ID NO: 459069 - DNA, 528 bp, Homo sapiens
  misc_feature: HEFZJCU01ADV9B.16.27.C05.1.454.heavy.3.raw
  modified_base (518)..(518): a, c, t, g, unknown or other
tgtactactccacgaccggtgctcgatttagacgcgatcgaagggtttgggggggagaggagcccagcattagaagtcggcggtgtttccattcggtgatcagcactgaacacagaggactcaccatggagtttgggctgacctgggttttcctcgttggtcttttaagaggtgtccagagtcaggtgcagctggtggagtctgggggaggcgttgtccagcctgggaggtcggtgagactctcctgtgaaggctctggattcacattcagtgactatggcatacactgggtccgccaggctccaggcaaggggctgaagtgggtggcgtttatttcatatgatggaactactcaacactatccagactccggggagggccgattcaccgtctccagagacaattccaagaacagggtgtttctccaagtgattgatctgagaagtgaggacacggctgtttattactgtgcgcggtggctgaccgctcttgactactggggccggggagccccggtnatcgtctccg

SEQ ID NO: 459070 - DNA, 499 bp, Homo sapiens
  misc_feature: HEFZJCU01CRIJU.49.42.D09.1.454.heavy.3.raw
agtcgagagacacgaccggtgctcgatttagacacatacgcagggaaagggggctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcacttatatcctatgatggaagcaataagcactacgcagagtccgtgaagggccgattgaccatctccagagacaactcgaagaatacggttcttctacaaatgaacagcctgagagctgaggacacggctatcttttactgtgcgagaggaactcgattacagcag

SEQ ID NO: 459071 - DNA, 511 bp, Homo sapiens; identical to SEQ ID NO: 445840
  misc_feature: HEFZJCU01ECBCW.11.13.B02.1.454.heavy.3.raw

SEQ ID NO: 459072 - DNA, 516 bp, Homo sapiens
  misc_feature: HEFZJCU01DXGTZ.49.28.C06.1.454.heavy.3.raw
  modified_base (434)..(434): a, c, t, g, unknown or other
agtcgagagacacgaccggtgctcgatttagagctcacgtattgggtttggggaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagattgaagacacggctgtgtnttactgtgcgagagcaacggtcgtcatggatttgactctggggccagggaaccccgtcaccgtctcctctgcctccaccaac

SEQ ID NO: 459073 - DNA, 544 bp, Homo sapiens
  misc_feature: HEFZJCU01AW8KT.13.40.D07.1.454.heavy.3.raw
tcacgtactacacgaccggtgctcgatttagtgatagagcgtaacaacagaggggtcctgtcccaagtgcaactacaacagtcgggcccaggactgctgaagcctgcacagaccctctccctcaattgcgtgatttccggtgtctccatcaccaatgatgattctaactggaactggctccgccaggtcccaggggggggcctggagtggcttggaagcatctctcaaagcgggacgaccgactataacccgtcttttaggagtcgagtctcgatttcaatagacaggtctaagacacaattctccctgagggtgacctctatgtcggccgcggacgcggccgtctattactgtgcgcgaggatctccgtcggaacacttcgtgacaagacaaaacgtccgaagtcgttatcactttgactcctggggccagggaaccctggtcagcgtctcttcagcctccaccaaggcccatcggtcttccccctggccaccctccctccaacgacgcacctctgggggcacgagcggccctgggcctgcct

SEQ ID NO: 459074 - DNA, 497 bp, Homo sapiens
  misc_feature: HEFZJCU01BN0ZS.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgttgcacagagatacgggcagcacgtggtttggggctactggggccagggaaccctggtcaccgtctcctcagcctccaccg

SEQ ID NO: 459075 - DNA, 518 bp, Homo sapiens
  misc_feature: HEFZJCU01CGGGU.9.34.D01.1.454.heavy.3.raw
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggccacctcctccaagagcacctctgggggcacagcggccctggctgcctggtcaaggactacttccagacgtatca

SEQ ID NO: 459076 - DNA, 396 bp, Homo sapiens; identical to SEQ ID NO: 444469
  misc_feature: HEFZJCU01B7BEU.47.46.E02.1.454.heavy.3.raw

SEQ ID NO: 459077 - DNA, 504 bp, Homo sapiens
  misc_feature: HEFZJCU01CW1BK.40.81.H04.1.454.heavy.3.raw
tctagcgactcacgaccggtgctcgatttagtagtgtagattcgcgggacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccactggggccagggaaccctggt

SEQ ID NO: 459078 - DNA, 506 bp, Homo sapiens
  misc_feature: HEFZJCU01D513Q.10.23.C01.1.454.heavy.3.raw
catagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcagctttgatgaatatgccatggactgggtccggcaagttccagggaaggcctggagtgggtctcaggtattgattggaatagtggtaccattgcctatgcggactctgtgaagggccgattcaccatcaccagagacgacgccaggagctccctgtatctaccaaatgaacagtctgagacctggaggacacggccttgtattactgtgtaagagggagtcgagggtttctaaac

SEQ ID NO: 459079 - DNA, 314 bp, Homo sapiens; identical to SEQ ID NO: 444774
  misc_feature: HEFZJCU01ECCG0.7.10.A10.1.454.heavy.3.raw

SEQ ID NO: 459080 - DNA, 504 bp, Homo sapiens; identical to SEQ ID NO: 445648
  misc_feature: HEFZJCU01CFMZG.17.25.C03.1.454.heavy.3.raw

SEQ ID NO: 459081 - DNA, 511 bp, Homo sapiens
  misc_feature: HEFZJCU01A15FB.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcgccctgggctgcctggtcaaggactacttccgagtgcgtct

SEQ ID NO: 459082 - DNA, 400 bp, Homo sapiens; identical to SEQ ID NO: 444452
  misc_feature: HEFZJCU01BXSUK.47.24.C02.1.454.heavy.3.raw

SEQ ID NO: 459083 - DNA, 502 bp, Homo sapiens; identical to SEQ ID NO: 444656
  misc_feature: HEFZJCU01BKASY.15.55.E11.1.454.heavy.3.raw

SEQ ID NO: 459084 - DNA, 392 bp, Homo sapiens
  misc_feature: HEFZJCU01A7VUG.7.60.F05.1.454.heavy.3.raw
cgtgtctctacacgaccggtgctcgatttagtacgtcatcagggaaaggggctggagtgggtctcagtgatttatagtagttccagttcatttcacgcagactccgtgaagggccgattcaccatctccagagacatttccaagaacacggtggatcttcagatggacagcctcagagcggaggacacggctgtctattactgtgtgagaggcgccaccgtggggatggaaacgatttttcttgtttgtctggggccagggaaccctggtcaccgtctcctcagcctccaccaagggcccatcggtcttcccctggcgccctgctccaggagcacctccgagagcacagcggccctgggctgcctggtcaaggactacttcctagagacacg

SEQ ID NO: 459085 - DNA, 510 bp, Homo sapiens; identical to SEQ ID NO: 449039
  misc_feature: HEFZJCU01C69BS.7.28.C06.1.454.heavy.3.raw

SEQ ID NO: 459086 - DNA, 374 bp, Homo sapiens; identical to SEQ ID NO: 444640
  misc_feature: HEFZJCU01EAZY4.7.37.D04.1.454.heavy.3.raw

SEQ ID NO: 459087 - DNA, 517 bp, Homo sapiens
  misc_feature: HEFZJCU01B22S5.19.85.H08.1.454.heavy.3.raw
tactctcgtgcacgaccggtgctcgatttagtatcactcagtcgcggggtctcagagaggtgccttagtcctggagtccaaggcacttccacttggtgatcagtactgaacacagaggactcaccatggagttggggttgtgctgggttttccttgtcgctattttagcaggtgtccaatgtgaggtggagttggtggagtctgggggaggcttggttcagcctggagggtccctgagagtctcctgcacagcctctggattcaccttcagtaactatgagatggactggatccgccaggctccaggaaaggggctggagtggattgcctatgtcactagtgagggcgaagtcacgtcctacgcggactctgtgcggggccggtttaccatctccagagacaatgccaagaagacgctctttctgcaattggacggcctgagagtcgaagacacggctattttattactgtgtgagaggaggggggcgacgtggcgtggtcgggtcggatcttttgt

SEQ ID NO: 459088 - DNA, 535 bp, Homo sapiens
  misc_feature: HEFZJCU01DX8YG.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggcccttcacagggcggtttgtcttctccatggatacctctgtcgggacggcttatctgcagataaccaaccttcaacctgacgacactgccgtttattttgtacgagagcgtcgtctgtcagtggaattgactactgggccagggaaccctggtccaccgtctcctcagcctccaccgaaggccc

SEQ ID NO: 459089 - DNA, 512 bp, Homo sapiens
  misc_feature: HEFZJCU01A7QRH.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttccccctggcaccctcctccaagagcacctctgggggcacagcggcctgggctgcctggtcaaggactacttccgagtgcgtct

SEQ ID NO: 459090 - DNA, 508 bp, Homo sapiens
  misc_feature: HEFZJCU01EROKS.10.5.A05.1.454.heavy.3.raw
catagtagtgcacgaccggtgctcgatttagatagatagacagggggtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaagcccggggagtctgtgaagatctcttgcacgggttcaggagacagatttagcagcgactggctcggctggttgcgccagatgcccggggaaggcctggagtggatggggatcatcaatcttggtagctctgaaaccagatacaccccgtccttccaaggccgggtcaccatctcagccgacaggtccatcagtactacctacttggagtggattagcctgaaggcctcggacaccgccatgtattactgtacgagacttgaacggggattctattatggcgcgatcgtggggccagggaaccctggtcaccg

SEQ ID NO: 459091 - DNA, 506 bp, Homo sapiens; identical to SEQ ID NO: 452457
  misc_feature: HEFZJCU01BQBS7.12.33.C11.1.454.heavy.3.raw

SEQ ID NO: 459092 - DNA, 498 bp, Homo sapiens; identical to SEQ ID NO: 448906
  misc_feature: HEFZJCU01BLSGJ.48.73.G07.1.454.heavy.3.raw

SEQ ID NO: 459093 - DNA, 494 bp, Homo sapiens
  misc_feature: HEFZJCU01EH23K.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtgcggtgactgctattgactactggggccagggaaccctggtcaccgtctcctcagcctccaccaagggcccatcggtcttcccctggcaccctcctccaagagcacctctgggggcacagcggccctgggctgcctggtcaaggacacttccgagtagtaca

SEQ ID NO: 459094 - DNA, 465 bp, Homo sapiens; identical to SEQ ID NO: 444805
  misc_feature: HEFZJCU01EZ4AH.19.10.A10.1.454.heavy.3.raw

SEQ ID NO: 459095 - DNA, 486 bp, Homo sapiens
  misc_feature: HEFZJCU01BO8K5.12.40.D07.1.454.heavy.3.raw
atacgacgtacacgaccggtgctcgatttagtgatagagcgtaacaacagaggactcaccatggagtttgggctgagcgtgggttttcctcgttgctcttttaagaggtgtccagtgtcaggggcacctggtggagtctggggctctgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggagccaggggaccctggtcatcgtctccccagcctccaccaagggcccatcggtcttccccctggcgccctgctccaggagcacctccgagagcacagcggccctgggctgcctggtcaaggactattcctacgtcgtat

SEQ ID NO: 459096 - DNA, 513 bp, Homo sapiens
  misc_feature: HEFZJCU01CDPAM.8.34.D01.1.454.heavy.3.raw
  modified_base (504)..(504): a, c, t, g, unknown or other
ctcgcgtgtccacgaccggtgctcgatttagatcgtctgtgttgagctctggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgatttggagctgaacagcctaagtcctgaggacacgggcgtatactactgtacgaaggaggggggaaccgagcggagttccagtacncctttgacg

SEQ ID NO: 459097 - DNA, 517 bp, Homo sapiens
  misc_feature: HEFZJCU01AFDUO.13.21.B10.1.454.heavy.3.raw
tcacgtactacacgaccggtgctcgatttagtgtcgtcgcaaagagagaggagccttagccctggactccaaggcctttccacttggtgatcagcaatgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacagttggggccggggaaccctgggtcaccggtcaac

SEQ ID NO: 459098 - DNA, 522 bp, Homo sapiens; identical to SEQ ID NO: 448016
  misc_feature: HEFZJCU01DUTRA.12.40.D07.1.454.heavy.3.raw

SEQ ID NO: 459099 - DNA, 391 bp, Homo sapiens
  misc_feature: HEFZJCU01AD2SC.53.60.F05.1.454.heavy.3.raw
cgcgtatacacacgaccggtgctcgatttagtacgtcatcagggaagggcctggagtgggtctcacatattagttgggggagtcgcagcctaggatatgcggagtctgtgaggggccggttcaccatctccagagacgacgccaggagttccttgtatctgcaaatgaacagtctgagaactgaagacacggccctctactattgtgtaaaaggggcactcggatacagcagcagttggtatgaccactggggccagggaatcctggtcaccgtctcctcagcctccaccaagggcccatcggtcttccccctggcaccctcctccaagagcacctctgggggcacagcggccctgggctgcctggtcaaggactacttcctcgtactgcg

SEQ ID NO: 459100 - DNA, 495 bp, Homo sapiens
  misc_feature: HEFZJCU01BEUHB.40.81.H04.1.454.heavy.3.raw
tctagcgactcacgaccggtgctcgatttagtagtgtagattcgcgggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggagagacgttggtggctaccgcggggctgaccactggg

SEQ ID NO: 459101 - DNA, 473 bp, Homo sapiens
  misc_feature: HEFZJCU01B42JH.48.51.E07.1.454.heavy.3.raw
agtatacatacacgaccggtgctcgatttagcatactctacaacacacaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaaggagcctggggcctcagtgaaggtctcctgcaaggcttctggatacaccttcaccggctactatttgcactggctgcgacaggcccctggacaagggcttgagtggatgggatggatctatcctaccagtggtggcacacgctattcacagaagtttcaggggcagggtcaccatgaccagggacacgtccatcagcacagcctacatggaattgagcaggctgacatctggacgacacgggccgtgtattatttgtgcgagag

SEQ ID NO: 459102 - DNA, 515 bp, Homo sapiens
  misc_feature: HEFZJCU01C290W.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagccaagacagattttggagtggttactggtttggacttactttgactacgtggggccaggggaaccctggt

SEQ ID NO: 459103 - DNA, 497 bp, Homo sapiens; identical to SEQ ID NO: 450948
  misc_feature: HEFZJCU01BXEMM.53.80.H03.1.454.heavy.3.raw

SEQ ID NO: 459104 - DNA, 504 bp, Homo sapiens
  misc_feature: HEFZJCU01A1G1T.47.48.E04.1.454.heavy.3.raw
agctcacgtacacgaccggtgctcgatttagagagcgtcacagagagaaggggctcagagaggagccttagccctggactccaaggcctttccacttggtgatcagcactgagcacagaggactcaccatggaattggggctgagctgggttttccttgttgctattttagaaggtgtccagtgtgaggtgcaattggtgcaatctggggaggcttggtccagcctgggggtccctcagactctcctgtgcagcctctggattcacctttagttcctcttggatgaattgggtccgccagactccagggaagggctggagtgggttggcaacataaatccagatggaagtcagaaaacctatgtggactctctgaagggccgattcaccatctccagagacaacgccaagaactctctgtttctgcaaatggacagcctgagagtcgaagacacggctgtgtattactgtgtgtctctgacgcctcggccggaccttggcttcg

SEQ ID NO: 459105 - DNA, 519 bp, Homo sapiens
  misc_feature: HEFZJCU01BWBFC.51.72.G06.1.454.heavy.3.raw
cgatcgtatacacgaccggtgctcgatttagctacgactgcaagggaaaggggcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatttcatatgatggaagtaaaatattctatgtagactccgtgaagggccgcttcatcatctccagagacaattcccagaacaccctgtttctgcaaatgcacagcctgagacctgaggacacggctgtgtattactgtgcgaacttaatcacggaggacaacggtgacccccgtccgctcggtgcggaggtctggggccaagggaccacggtcatcgtctcctcagcctccaccaagggcccatcggtcttccccctggcaccctcctccaagacgcacctctggggggcacagcggccctgggctgcctggtcaaggacta

SEQ ID NO: 459106 - DNA, 517 bp, Homo sapiens; identical to SEQ ID NO: 446078
  misc_feature: HEFZJCU01DQOTP.9.34.D01.1.454.heavy.3.raw

SEQ ID NO: 459107 - DNA, 504 bp, Homo sapiens
  misc_feature: HEFZJCU01B7BXC.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaagcgggaattggtggcggtgactgctattgactactgggg

SEQ ID NO: 459108 - DNA, 513 bp, Homo sapiens
  misc_feature: HEFZJCU01DAF3M.52.71.G05.1.454.heavy.3.raw
  modified_base (483)..(483): a, c, t, g, unknown or other
cgcagtacgacacgaccggtgctcgatttagtgtcgtcgcaagagagagggggagctctgagagaggagcccagccctgggattttcaggtgttttcatttggtgatcaggactgaacagagagaaatcaccatggagtttgggctgagctggctttttcttgtggctattttaaaaggtggccaatgtgaggtgcagctggtggagtctgggggaggcttggtacagcccggggggtccctgagactctcctgtgcagcctctggattcagttttaccagctatgccatggcctgggtccgccaggctccagggaaggggctggagtgggtctcagggtattagtggtagtgctatgaccacattctacgcagactccgtgaagggccggttcacccatttcccagagacaattccaagagtaccctgtatctgcaaatgaacagcctgagaagccgacgacacggccgtatattactgtgngaagcaattactctatggacatttatgggg

SEQ ID NO: 459109 - DNA, 511 bp, Homo sapiens
  misc_feature: HEFZJCU01DNTQW.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggccaac

SEQ ID NO: 459110 - DNA, 502 bp, Homo sapiens
  misc_feature: HEFZJCU01DUM6S.51.23.C01.1.454.heavy.3.raw
cgatcgtatacacgaccggtgctcgatttagtacacgtgattagggattgggggcatcacataacaaccagattcctcctctaaagaagcccctgggagcacagctcatcaccatggactggacctggaggttcctctttgtggtggcagcagttacaggtgtccattcccaggtccagctggtgcagtctggggctgaggtgaagatgcctgggtcctcggtgaaggtctcctgcaagtattctggaggcaccttcagcaactatggtatcagctgggtgcgacaggcccctggacaagggcttgagtggatgggaagggtcacccctatatttgatgtagcagactctgcacagaagttccagggcagaataacaattacggcggacaaatccacgaccacagcctacatggagctgagcagcctgagatctgaggacacggcccttttattactgtgcgagatttaccggtgggggtcgacggcggatatatcgccata

SEQ ID NO: 459111 - DNA, 508 bp, Homo sapiens
  misc_feature: HEFZJCU01A3GL3.49.34.D01.1.454.heavy.3.raw
agtcgagagacacgaccggtgctcgatttagatcgtctgtgttgggtttggggggaagaggaagactgacggtcctcccaggagttcaggtgctgggcaccgtgggcatgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggcccatcggtcttcccctggcgccctgctccagga

SEQ ID NO: 459112 - DNA, 535 bp, Homo sapiens
  misc_feature: HEFZJCU01BBCI0.14.57.F02.1.454.heavy.3.raw
cgtctagtaccacgaccggtgctcgatttagctcgatatagttgggtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctgggccaagggacgctggtcaccgtctcttcagcctccacaagggcccatcggtcttcccctcggcaccctcctccagagcacctctgggggcacagcc

SEQ ID NO: 459113 - DNA, 513 bp, Homo sapiens
  misc_feature: HEFZJCU01CH9Z9.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaagggcccatcggtcttcccctggccgcctgctccaggagcacc

SEQ ID NO: 459114 - DNA, 505 bp, Homo sapiens
  misc_feature: HEFZJCU01ESC7P.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccgttcaccctctccagagacacttccaacaacatcttgtatcttcacatgcacaatctgagagtcgacgacacggccacctattattgtgcgcgacatgactacgctcaattctggggccagggacg

SEQ ID NO: 459115 - DNA, 541 bp, Homo sapiens
  misc_feature: HEFZJCU01BSGXW.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggtccgtttcaccatctccagagacaacgccaagaattcactgtatctacaactgaacagcctgagagtcgcagacacgggccgtgtattactgtgcgagatgtaggaaaagtatggctgtgtttagttggggccaggggacgccctggtcctaccg

SEQ ID NO: 459116 - DNA, 477 bp, Homo sapiens; identical to SEQ ID NO: 444659
  misc_feature: HEFZJCU01BX4Z3.16.10.A10.1.454.heavy.3.raw

SEQ ID NO: 459117 - DNA, 528 bp, Homo sapiens
  misc_feature: HEFZJCU01AY8EQ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtcccgtgacgactacggcctgtgttggcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatcggtcttccccctggcg

SEQ ID NO: 459118 - DNA, 483 bp, Homo sapiens
  misc_feature: HEFZJCU01CUBDF.40.71.G05.1.454.heavy.3.raw
tctagcgactcacgaccggtgctcgatttagtgtcgtcgcaagagagaggggacccaaaaaccacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttaccgactatggtatgagctgggtgcgacaggcccccggacaagggcttgagtggatgggatggagcagcacttacaatggtgacacaaactatgcacagaagttccaggacagagtcaccatgaccacagacacatcccaccagcacagcctatatggaggtgaggagcctgacatctgacgacacggccgtatattactgtgcgagagatcatcggaggtggaatgccgtgt

SEQ ID NO: 459119 - DNA, 520 bp, Homo sapiens
  misc_feature: HEFZJCU01DE351.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtggggccaagggacccg

SEQ ID NO: 459120 - DNA, 522 bp, Homo sapiens
  misc_feature: HEFZJCU01EUQEY.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgacccgtgaagggccgattaaccatctccagagacgattccgagaacacggtgtatcttcaaatgaacaacctgagagccgacgacacggccgtttattactgtgcgagagattcgaggtggttcggggacctcaccctggttctacttcgatctctggggcc

SEQ ID NO: 459121 - DNA, 479 bp, Homo sapiens; identical to SEQ ID NO: 449486
  misc_feature: HEFZJCU01EP6O8.26.78.H01.1.454.heavy.3.raw

SEQ ID NO: 459122 - DNA, 493 bp, Homo sapiens; identical to SEQ ID NO: 455531
  misc_feature: HEFZJCU01ETOPQ.47.85.H08.1.454.heavy.3.raw

SEQ ID NO: 459123 - DNA, 515 bp, Homo sapiens
  misc_feature: HEFZJCU01C5L8H.4.25.C03.1.454.heavy.3.raw
agcactgtagcacgaccggtgctcgatttagtagtgtagatttgggtttgggctgagctgggttttcctcgttgctcttttaagaggtgtccagtgtcacgtgcgcctggtggagtctgggggaggcgttgtccagcctgggaggtccctgagactctcctgtgcagcgtctgcattcaccttcaggagctatgggatgcactgggtccgccaggctccaggcaaggggctggagtgggtggcacttatttggtatgatggaagtaagaaatactatgcagagtccgtgaagggccgattcaccatctccagagacaattccaacaacacgctgtttctgcaaatgaacagcctgagagccgaggacacggctgtgtatcactgtgtcagagatgccgagggcggttaccccgtctggttccttcgacagtatggtatggacgtctggggcctagggactacggtcaccgtctcctcagcctccacccaaggcccatcggtctttcccctggcta

SEQ ID NO: 459124 - DNA, 495 bp, Homo sapiens
  misc_feature: HEFZJCU01A3YON.48.59.F04.1.454.heavy.3.raw
agtatacatacacgaccggtgctcgatttagtacacacacttagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaagggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagccgcagtggctttttgatgccttgatatgtgggccaagggacaat

SEQ ID NO: 459125 - DNA, 531 bp, Homo sapiens
  misc_feature: HEFZJCU01AGYW9.3.70.G04.1.454.heavy.3.raw
agacgcactccacgaccggtgctcgatttagtgtagtgtgaagggaaaggggggagaggagcccaccactgggattccgaggtgtttccattcggtgatcagcactgaacacagaggactcaccatggagttttggctgagctgggttttccttgttgctatttcaaaaggtgtccagtgtgaggtgcagctggtggagactggaggaggcttgatccagcccggggggtccctgagactctcctgtgaagtctctgggttcactgtcagtagcaactacatgaactgggtccgccaggctccagggaaggggccggagtgggtctcaattatttatggcgatggtagtacgtactacgcagactccgtgcagggccgattcaccatctccagagacaatttcaagaatacgttgctccttcaaatgaacaacctgagaaccgaggacacggccgtatattattgtgcgagtagtacggtggtgaatgtgggtgttaactgggcctgggaaccctggtcaccgtctcctca

SEQ ID NO: 459126 - DNA, 500 bp, Homo sapiens; identical to SEQ ID NO: 445720
  misc_feature: HEFZJCU01D6X3M.3.20.B09.1.454.heavy.3.raw

SEQ ID NO: 459127 - DNA, 489 bp, Homo sapiens
  misc_feature: HEFZJCU01B9XV2.53.56.F01.1.454.heavy.3.raw
cgcgtatacacacgaccggtgctcgatttagcagacgtctgaacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcagggcagggtcaccatgaccagggacacgtccatcagcacagcctacatggagctacacggcctgagatctgacgacacggcccctgtatttttgtgtcgagagagtctattaaagtggctt

SEQ ID NO: 459128 - DNA, 522 bp, Homo sapiens
  misc_feature: HEFZJCU01AEH8H.12.40.D07.1.454.heavy.3.raw
  modified_base (505)..(505): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccancggtcttccccctggcg

SEQ ID NO: 459129 - DNA, 511 bp, Homo sapiens
  misc_feature: HEFZJCU01B1VTU.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaaggccgattcaccatctccagagacaattccaggaacacaatgtatttggagctgaacagcctaagtcctgaggacacgggcgtatactactgtacgaagggaggggggaaccaggcgggagttccaagtactcctttg

SEQ ID NO: 459130 - DNA, 525 bp, Homo sapiens
  misc_feature: HEFZJCU01ARWC9.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgattttttggatgtctggggccaaggtacagcggtcaccgtcgcctcagcctccaccaagggcccatcggtcttccccctggccaccctcctccaagagcacctctggggggcacgacg

SEQ ID NO: 459131 - DNA, 508 bp, Homo sapiens; identical to SEQ ID NO: 445594
  misc_feature: HEFZJCU01CK369.17.25.C03.1.454.heavy.3.raw

SEQ ID NO: 459132 - DNA, 514 bp, Homo sapiens; identical to SEQ ID NO: 449159
  misc_feature: HEFZJCU01A9RJP.9.70.G04.1.454.heavy.3.raw

SEQ ID NO: 459133 - DNA, 477 bp, Homo sapiens; identical to SEQ ID NO: 444659
  misc_feature: HEFZJCU01A1YXC.16.10.A10.1.454.heavy.3.raw

SEQ ID NO: 459134 - DNA, 518 bp, Homo sapiens
  misc_feature: HEFZJCU01CKMMQ.9.43.D10.1.454.heavy.3.raw
tgatacgtctcacgaccggtgctcgatttagactagcagtaagggggggagaggagcccagcactgggattccgaggtgtttccattcggtgatcagcactgaacacagaggactcaccatggagttttggctgagctgggttttccttgttgttatttctaaaggtgtccagtgtgaggtgcaactggtggagagtggaggaggcttgatccagcctggggggtccctgagactctcctgtgcagcctctggcttcgccgtcagtggcgactacatgacctgggcccgccaggctccagggaaggggctggaatgggtctcagttattcataccgacggtaccatatatgacgcagactccgtgaagggccgattcaccatctccagagaccattccaagaacaccctatatcttcaaatgaacaacctgagagtcgaagacacggccgtatattactgtgcgagacatgacttcggtgacccctggggccagggaaccctggtcaccgtctcctca

SEQ ID NO: 459135 - DNA, 482 bp, Homo sapiens; identical to SEQ ID NO: 444503
  misc_feature: HEFZJCU01A39G7.7.10.A10.1.454.heavy.3.raw

SEQ ID NO: 459136 - DNA, 545 bp, Homo sapiens
  misc_feature: HEFZJCU01BJYCJ.15.86.H09.1.454.heavy.3.raw
tctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcacccgtgaaaggaagattcaccatctcaagagataattcaaaacgacggtgtatttgcaaatgaacagcctgaaaaccgaggacacagccgtctattactgtaccacagattcggaagtgcatcgacgtaaaggaggctatgcttttgattatctggggcccagggacaat

SEQ ID NO: 459137 - DNA, 521 bp, Homo sapiens; identical to SEQ ID NO: 445317
  misc_feature: HEFZJCU01DKU8Q.12.40.D07.1.454.heavy.3.raw

SEQ ID NO: 459138 - DNA, 499 bp, Homo sapiens
  misc_feature: HEFZJCU01CQWZT.11.57.F02.1.454.heavy.3.raw
cgagagataccacgaccggtgctcgatttagctcgatatagttgggtttgggggctctcagagaggtgccttggtcctggattccaaggcatttccacttggtgatcagcactgaacacagaggactcaccatggagttggggctgtgctgggttttccttgttgctattttagaaggtgtccagtgcgaggtgcaagtggtgcagtctgggggaggcttagtccagccgggggggtccctgagactctcctgtctagtctctggattcgccttcagtgactatgccatgaagtgggtccgccaggctccaggtaaggggctggaatggatttcatacattagcagtagtggtgcgaccatatactacgcagactctgtgaagggccgattcatcatctccagagacaatggcaacaactcactgtatctggaaatcaacagcctgagagtcgaggacacggctgtatattattgtgcgagagccccctacggtgtacg

SEQ ID NO: 459139 - DNA, 507 bp, Homo sapiens
  misc_feature: HEFZJCU01AVJY6.9.12.B01.1.454.heavy.3.raw
tgatacgtctcacgaccggtgctcgatttagtagtgtagattccgcggggagctctgggagagtagcccagcactgggattccgaggtgtttccattcagtgatctgcactgaacacagaggactcgccatggagtttgggctgagctgggttttccttgttgctattttaaaaggtgtccagtgtgaggtgcagctggtggagtctgggggaggcttggtccagcctggggggtccctgaaactctcctgtgcagcctctggatacaccgtcagtagtaactccatgaactgggtccgccaggctccagggaaggggctggagtgggtctcagttatttatagcggtggtaacacatactacgcagactccgtgaagggcagattcaccatctccagagacaattccaggaacacgctgtatcttcaaatgaacagcctgagagtcgaggacacggctgtatattactgtgcgagagatgtgtacgcttttgatatctggggccaa

SEQ ID NO: 459140 - DNA, 523 bp, Homo sapiens; identical to SEQ ID NO: 446270
  misc_feature: HEFZJCU01BJ19M.12.40.D07.1.454.heavy.3.raw

SEQ ID NO: 459141 - DNA, 514 bp, Homo sapiens
  misc_feature: HEFZJCU01BMHFB.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatacgtggggccagggaaccctggtccgtcccg

SEQ ID NO: 459142 - DNA, 518 bp, Homo sapiens; identical to SEQ ID NO: 444718
  misc_feature: HEFZJCU01EFS63.9.34.D01.1.454.heavy.3.raw

SEQ ID NO: 459143 - DNA, 512 bp, Homo sapiens
  misc_feature: HEFZJCU01BEESV.12.33.C11.1.454.heavy.3.raw
atacgacgtacacgaccggtgctcgatttagagtgagctcgttgggtttgggagaggagccccagccctgagattcccacgtgtttccatccagtgatcagcactgaacacagaggactcgccatggagtctgggctgaactgggttttccttgttgctattttaaaaggtgtccactgtgaggtgcaactggtggagtcggggggaggtgtagtacggccgggggggtccctgagactctcatgtgcagggtctggattcaacttttacgattatggcatgacctgggtccgccaagctccagggaagggctggagtgggtctctggtctgaattggaatggtgatagtatagattatgcaggctctgtgaggggccgattcaccatctccagagacaacgccaagaactccctgtttctgcaaatggacatttgagagaggaagacacggccttatatttctgtgcgagagccctcggcagaagtctggactactactattatggtatgg

SEQ ID NO: 459144 - DNA, 514 bp, Homo sapiens; identical to SEQ ID NO: 446516
  misc_feature: HEFZJCU01APRVQ.12.55.E11.1.454.heavy.3.raw

SEQ ID NO: 459145 - DNA, 518 bp, Homo sapiens; identical to SEQ ID NO: 444718
  misc_feature: HEFZJCU01EAUVN.9.34.D01.1.454.heavy.3.raw

SEQ ID NO: 459146 - DNA, 510 bp, Homo sapiens; identical to SEQ ID NO: 449039
  misc_feature: HEFZJCU01AZ99G.7.28.C06.1.454.heavy.3.raw

SEQ ID NO: 459147 - DNA, 518 bp, Homo sapiens
  misc_feature: HEFZJCU01EX6V9.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaatgaacagcctaagtcctgaggacacgggtgtatatactgtacgaaggaggggggaaccgagcggggagtacgaagtacttcttgacgtcgtcgggcgtac

SEQ ID NO: 459148 - DNA, 528 bp, Homo sapiens
  misc_feature: HEFZJCU01DZ91H.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctcaccaa

SEQ ID NO: 459149 - DNA, 532 bp, Homo sapiens; identical to SEQ ID NO: 455739
  misc_feature: HEFZJCU01E0M36.17.28.C06.1.454.heavy.3.raw

SEQ ID NO: 459150 - DNA, 475 bp, Homo sapiens; identical to SEQ ID NO: 451354
  misc_feature: HEFZJCU01B3YHL.16.10.A10.1.454.heavy.3.raw

SEQ ID NO: 459151 - DNA, 530 bp, Homo sapiens
  misc_feature: HEFZJCU01DH7IT.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctccctgaggctgagctctgtgacagccgcggacacgggcgtttattactgtgcgagagggacggactacggtgactacgtgggggttaccgaccccgtggggccagggaaccctggtcaccgtctcctcagcctccaccg

SEQ ID NO: 459152 - DNA, 511 bp, Homo sapiens
  misc_feature: HEFZJCU01DAC1V.17.25.C03.1.454.heavy.3.raw
cgtagactagcacgaccggtgctcgatttagtagtgtagatttgggtttggggaaccacatctgtcctctagagaaaaccctgtgagcacaactcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggcctttgacttctggggccagggagcccg

SEQ ID NO: 459153 - DNA, 503 bp, Homo sapiens
  misc_feature: HEFZJCU01C2WLM.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtggcgttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacaacggccatatattactgtgcgaaagcaccggcagttagtcacccatacctactttgact

SEQ ID NO: 459154 - DNA, 518 bp, Homo sapiens
  misc_feature: HEFZJCU01DF59W.52.74.G08.1.454.heavy.3.raw
cgcagtacgacacgaccggtgctcgatttagtagctctatcaggggatgctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggagtggttattattgggcctggatccggcagccccccgggaaggggctggagtggatcggcagcatccatcatagtggagacaataatcacaatccgtccctcagaggacgagtcaccttttcagtggagacgtccaagaaccaattctccctgaaattgacctctctgaccgccgccgacacggccctttattactgtgcgcgagtgaacacagcaataacttattatgttgaatattggggccagggaaccccggtcaccatctcctcagcctccaccaacgggccc

SEQ ID NO: 459155 - DNA, 458 bp, Homo sapiens
  misc_feature: HEFZJCU01CAMUT.15.28.C06.1.454.heavy.3.raw
tctacgtagccacgaccggtgctcgatttagagctcacgtattgggtttgggggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggcccatcggtcttcccctggcgccctgctccaggagcacctccgagagcacagcggccctgggctgcctggtcaaggactacttccgctacgtaga

SEQ ID NO: 459156 - DNA, 526 bp, Homo sapiens
  misc_feature: HEFZJCU01AKE2W.4.12.B01.1.454.heavy.3.raw
agcactgtagcacgaccggtgctcgatttagtagtgtagattccgcggggctgtgcaagaacatgaaacatctgtggttcttccttctcctggtggcagttcccagatgggtcctgtcccaggtgcagctgcgggagtcgggcccaggactggtgaagccttcggaggaccctgtccctcacctgcactgtctctggtggcttcatggatggttactactggagttgggtccggcagtccccaacacagggactgcagtggattggatacatctacttcagtgggaaccccaactacaacccctccctcaggattccagtcgccatatccctggactcgtccaacaaccagatctccctgacgatgacatctgtgaccgctgcggacacagccgtttattactgtgcgcgatctgggcgactcagtgactatggtatggacgtctggggccaagggaccacggtcatcgtctcctcacgcctccaccaacggcccgactcggtcctttccccctcggtcctacccc

SEQ ID NO: 459157 - DNA, 480 bp, Homo sapiens; identical to SEQ ID NO: 445011
  misc_feature: HEFZJCU01DT8NH.22.36.D03.1.454.heavy.3.raw

SEQ ID NO: 459158 - DNA, 489 bp, Homo sapiens
  misc_feature: HEFZJCU01E05OT.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagactgatatctgaagacacggctgtatattactgtgcgaggattgcagtggagagtccttactactactactactacatggacgtctggggcaaagggaccacggtcaccgtctcctcggcctccaccaagggcccatcggtcttcccctggcgccctgctccaggagcacctccgagagcacagcggccctgggctgcctggtcaaggactacttcccatactcgta

SEQ ID NO: 459159 - DNA, 529 bp, Homo sapiens; identical to SEQ ID NO: 454216
  misc_feature: HEFZJCU01EGLLE.49.27.C05.1.454.heavy.3.raw

SEQ ID NO: 459160 - DNA, 488 bp, Homo sapiens
  misc_feature: HEFZJCU01CFM9W.12.40.D07.1.454.heavy.3.raw
atacgacgtacacgaccggtgctcgatttagtgatagagcgtaacaacagaggactcacctttatggagtttgggctgagctgggttttcctcgttgctcttttaagaggtgtccagtgtcaggggcacctggtggagtctggggctctgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggagccaggggaccctggtcatcgtctccccagcctccaccaagggcccatcggtcttcccctggcgccctgctccaggagcacctccgagagcacagcggccctgggctgcctggtcaaggactacttcctacgtcgtat

SEQ ID NO: 459161 - DNA, 489 bp, Homo sapiens
  misc_feature: HEFZJCU01AMD08.11.38.D05.1.454.heavy.3.raw
cgagagataccacgaccggtgctcgatttagtatctgatagttgggtttgggggaggcttggtacagcctggggggtccctgagactctcctgtgcagcgtctggattcacctttagcagctatgccatgacctgggtccgccaggctccagggaaggggctggagtgggtctcagctattagtgatagtggtggtagcacatactacgcagactccgtgaagggccggttcaccatctccagagacaattccatgaacacgctgtatctgcaaatgaacagcctgagagccgaggacacggccgtatattactgtgcgcagatagattgtagtggtggtagctgctactggggccagggaaccctggtcaccgtctcctcagcctccaccaggcccatcggtcttcccctggcaccctcctccaagagcacctctgggggcacagcggccctgggctgcctggtcaaggactacttccgtatctctcg

SEQ ID NO: 459162 - DNA, 531 bp, Homo sapiens; identical to SEQ ID NO: 458117
  misc_feature: HEFZJCU01BQ534.7.78.H01.1.454.heavy.3.raw

SEQ ID NO: 459163 - DNA, 499 bp, Homo sapiens
  misc_feature: HEFZJCU01B7ZVO.51.59.F04.1.454.heavy.3.raw
cgatcgtatacacgaccggtgctcgatttagtacacacacttagggattgggggcatcacataacaaccagattcctcctctaaagaagcccctgggagcacagctcatcaccatggactggacctggaggttcctctttgtggtggcagcagttacaggtgtccattcccaggtccagctggtgcagtctggggctgaggtgaagatgcctgggtcctcggtgaaggtctcctgcaagtattctggaggcaccttcagcaactatggtatcagctgggtgcgacaggcccctggacaagggcttgagtggatgggaagggtcacccctatatttgatgtagcagactctgcacagaagttccagggcagaataacaattacggcggacaaatccacgaccacagcctacatggagctgagcagcctgagatctgaggacacggccctttattactgtgcgagatttaccgtgggggtcacggcggatatatcgccata

SEQ ID NO: 459164 - DNA, 507 bp, Homo sapiens; identical to SEQ ID NO: 454089
  misc_feature: HEFZJCU01CGVXU.14.78.H01.1.454.heavy.3.raw

SEQ ID NO: 459165 - DNA, 496 bp, Homo sapiens; identical to SEQ ID NO: 445798
  misc_feature: HEFZJCU01ATWB9.12.55.E11.1.454.heavy.3.raw

SEQ ID NO: 459166 - DNA, 498 bp, Homo sapiens
  misc_feature: HEFZJCU01B69MI.3.20.B09.1.454.heavy.3.raw
  modified_base (439)..(439): a, c, t, g, unknown or other
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtctggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgngactggccgcaacagactacggtggcaactcctatgcttttgatatctggggccaaggg

SEQ ID NO: 459167 - DNA, 519 bp, Homo sapiens
  misc_feature: HEFZJCU01BTWS7.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggctccaggggaaggggctggagtgcgtctcttttatttatagtagtggtagtacatactccgcagactccgtgaggggccgattcaccatctccagagacaattccaagaacacgctgttcttcaaatgaacagcctgagagccgatgacacggccgtgtattactgtgcgagagagtggggcccacgaacgttactacgctatggacgtctggggccaagggaccg

SEQ ID NO: 459168 - DNA, 502 bp, Homo sapiens
  misc_feature: HEFZJCU01B0206.51.3.A03.1.454.heavy.3.raw
cgatcgtatacacgaccggtgctcgatttagagagcgtcacaggggacccaacaaccacatccctcctcagaagcccccagagcacaacgcctcaccatggactggacctggaggatcctctttttggtggcagcagccacaggtgccgactcccaggtccaacttgtgcagtctggggctgagttgaagaagcctggggcctcagtgaaggtttcctgcatggtttctggatattccctgactagtcatgctatgcattgggtgcgccaggcccccggacaaagctttgagtggatgggatggatcaccgctggcaatggtgacacaaaatattcacagaagttccagggcagagtcaccattaacagggacacatctgcgagtacaggctacatggaactgagcggcctggagatcgtgaggacacgggctatttattactgtgcgagagggaagtggggatattgtggcagctccaggtgcccagccggcccccttacg

SEQ ID NO: 459169 - DNA, 509 bp, Homo sapiens
  misc_feature: HEFZJCU01EAUH4.48.82.H05.1.454.heavy.3.raw
agtatacatacacgaccggtgctcgatttagtcgagctctctcgcgggcacgaccggtgctcgatttagatcgtctgtgttgggtttggggggaagaggaagtccctgacactgtcctgcacagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctgcgccctgctccagagcacctccgagagcacagcggccctgggctgcctggt

SEQ ID NO: 459170 - DNA, 511 bp, Homo sapiens
  misc_feature: HEFZJCU01E1X4U.13.87.H10.1.454.heavy.3.raw
tcacgtactacacgaccggtgctcgatttagcagtactgcgttgggtttgggggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaagataccaaccccttacgattttggtagtggttacg

SEQ ID NO: 459171 - DNA, 530 bp, Homo sapiens
  misc_feature: HEFZJCU01AP03G.48.12.B01.1.454.heavy.3.raw
agtatacatacacgaccggtgctcgatttagtagtgtagattccgcgggggctttctgagagtcatggatctcatgtgcaagaaaatgaagcacctgtggttcttcctcctgctggtggcgtctcccagatgggtcctgtcccagctgcacctgcaggagtcgggcccaggactggtgaggccttcggagaccctgtccctcacctgcactgtctctggtgactccatcaacagtggtactttttactactggggctggatccgccagaccccagggaagggtctggagtggattgggagtgtctattctagtgggaacacccactacaatccgtccctcaagagtcgagtcaccatatccgtggacacgtccaagaacgagttctccctgaggttacaatctgtgaccgccgcagacacggctgtatattactgtgcgagacaccgggagggggcttactatggatcgggcgggaggttactactttgactacgtggggccagggagtcctggtcaccgtctcctcacg

SEQ ID NO: 459172 - DNA, 510 bp, Homo sapiens
  misc_feature: HEFZJCU01BERIN.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggaatgaacagcctaagtcctgaggacacgggtgtatactactgtacgaaggaggggggaacagcgggagtcaagtactcttgacgtctgggctac

SEQ ID NO: 459173 - DNA, 493 bp, Homo sapiens; identical to SEQ ID NO: 450212
  misc_feature: HEFZJCU01DUQHW.13.71.G05.1.454.heavy.3.raw

SEQ ID NO: 459174 - DNA, 399 bp, Homo sapiens
  misc_feature: HEFZJCU01CT8DX.47.24.C02.1.454.heavy.3.raw
agctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttcccctggcgccctgctccaggagcacctccgagagcacagcggccctgggctgcctggtcaaggactacttcctacgtgagct

SEQ ID NO: 459175 - DNA, 396 bp, Homo sapiens; identical to SEQ ID NO: 445818
  misc_feature: HEFZJCU01A8S59.16.68.G02.1.454.heavy.3.raw

SEQ ID NO: 459176 - DNA, 488 bp, Homo sapiens
  misc_feature: HEFZJCU01DICIJ.47.55.E11.1.454.heavy.3.raw
agctcacgtacacgaccggtgctcgatttagcactcgcacgttgggtttgggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaaccctggtcagcgtctcctcagcctccaccaagggcccatcggtcttcccctggcgccctgctccaggagcacctccgagagcacagcggcccgtcgggctgcctggtcaaggactacttcctacgtgagct

SEQ ID NO: 459177 - DNA, 502 bp, Homo sapiens; identical to SEQ ID NO: 451203
  misc_feature: HEFZJCU01EFN15.10.38.D05.1.454.heavy.3.raw

SEQ ID NO: 459178 - DNA, 385 bp, Homo sapiens
  misc_feature: HEFZJCU01EZH1E.11.20.B09.1.454.heavy.3.raw
cgagagataccacgaccggtgctcgatttagtgtagtgtgaaggggtacgtgccaagcatcctcgtgcgaccgcgagagcccggggagcgggggcttgccggccgattcaccatctcccgagacgattccaacaatatgttctatctgcaaatgagccgcctgagaagcaaggacacggctgtctattactgtgcgagagacggatttctgcactctacctactacttcttctacatggacgtctggggcagagggacaacggtcaccgtctccttagcctccaccaagggcccatcggtcttccccctggcaccctcctccaagagcacctctgggggcacagcggccctgggctgcctggtcaaggactacttccgtatctcg

SEQ ID NO: 459179 - DNA, 509 bp, Homo sapiens
  misc_feature: HEFZJCU01AU6X8.2.33.C11.1.454.heavy.3.raw
acgctcgacacacgaccggtgctcgatttagagtgagctcgttgggtttggggagccccagccttgggattcccaagtgttttcattcagtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaaatgaacagcctggaagacgcggacacagccatgtattattgtacattaggacactatagtccctggggccagggaaccctc

SEQ ID NO: 459180 - DNA, 511 bp, Homo sapiens; identical to SEQ ID NO: 445840
  misc_feature: HEFZJCU01EFMY8.11.13.B02.1.454.heavy.3.raw

SEQ ID NO: 459181 - DNA, 514 bp, Homo sapiens
  misc_feature: HEFZJCU01D7RGX.40.28.C06.1.454.heavy.3.raw
tctagcgactcacgaccggtgctcgatttagagctcacgtattgggtttggggggaagaggaagactgacggtcctgccacaggtggccactcccaggtccactttgtgcagtctggggctgaggtgcagaagcccggggcctcagtgacgatttcctgcaaggcttctggatacagcttcagtagttatgctatacagtgggtgcgccaggcccccggacaaaggcttgagtggctgggatggatcgtcggtggcactcctaacataagatattcacagaagtttcagttcagagtcacctttagcagcgacacatccgcgacgacagtctacatggagttgagtggcctaagatctgaagacacggctgtctattactgtgcgagagatgccttacacgacgagggggcccactttgattactggggccagggaaccctggtcaccgtctcctcagcctccaccaagggcccatcggtcttcccctggcgccctgctccaggagcacctccg

SEQ ID NO: 459182 - DNA, 508 bp, Homo sapiens
  misc_feature: HEFZJCU01DO1OV.3.85.H08.1.454.heavy.3.raw
  modified_base (439)..(439): a, c, t, g, unknown or other
  modified_base (493)..(493): a, c, t, g, unknown or other
agacgcactccacgaccggtgctcgatttagtatcactcagtcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctggtggagtctgggggaggcttggtacagcctggggggtccctgagactctcctgtgcagcctctggattcacctttagtaattatgccatgagctgggtccgcaggctccagggaaggggctggagtgggtctcagctattagtgatcgtggtggtaacacatactacgcagactccgtgaagggccgcttcaccatctccagagacaattccaagaacacgctgcatctgacaaatgaaacngcctgagagccgaggacaccggccctttatactgtgacgaaaccaatcacgtanaactggaactacgta

SEQ ID NO: 459183 - DNA, 539 bp, Homo sapiens
  misc_feature: HEFZJCU01CLC0L.18.59.F04.1.454.heavy.3.raw
tacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggaaggggctggagtgggttggccgtattaaaaccaaaactgatggtgggacaacagactacgctgcacccgtgaaaggcagattcaccatctcaagagatgattcaaaagcacgctgtatctgcaaatgaacagcctgagaaccgaggacacagccgtgtattactgtaccacatcccctgaaagcgtcaactactactactacggtatggacctctgggccagggaccg

SEQ ID NO: 459184 - DNA, 501 bp, Homo sapiens
  misc_feature: HEFZJCU01DK03E.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgtttctaggtggctaattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgact

SEQ ID NO: 459185 - DNA, 526 bp, Homo sapiens
  misc_feature: HEFZJCU01B3ZOM.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctggcgcctcg

SEQ ID NO: 459186 - DNA, 502 bp, Homo sapiens
  misc_feature: HEFZJCU01EC1BV.14.59.F04.1.454.heavy.3.raw
cgtctagtaccacgaccggtgctcgatttagtacacacacttagggattgggggggagaggagcccagcactagaagtcggcggtgtttccattcggtgagcagcactgaacacagaggactcaccatggagtttgggctgagctgggttttcctcgctgctcttttaagaggtgtccagtgtcaggggcagctggtggagtctgggggaggcgtggtccagcctgggaggtccctgagactctcctgtgcagcgtctggattcaccttcagaaactctggcatgcactgggtccgccaggctccaggcaaggggctggagtgggtggcacttatatggtatgatggaagtaatgaaaactatgcagactccgtgaagggccgattcaccatctccagagacaattccaagaacacagtgtatctgcaaatgagcagcctgagagtcgaggacacggctgtgtattactgtgcgagagatgtttttatggtttcggggagtt

SEQ ID NO: 459187 - DNA, 495 bp, Homo sapiens
  misc_feature: HEFZJCU01CP5OR.12.55.E11.1.454.heavy.3.raw
atacgacgtacacgaccggtgctcgatttagcactcgcacgttgggtttgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttccccctggcgccctgctccagagcacctctggggcacagcggccctgggctgcctggtcaggactactccctacgtcgtat

SEQ ID NO: 459188 - DNA, 511 bp, Homo sapiens
  misc_feature: HEFZJCU01A3YT0.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttctggggccagggaaccc

SEQ ID NO: 459189 - DNA, 511 bp, Homo sapiens
  misc_feature: HEFZJCU01DHX8R.48.39.D06.1.454.heavy.3.raw
agtatacatacacgaccggtgctcgatttagtgacatctcgcagttctttgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctacaaaagtcgaggcaccatatccgtagacacgtccaagaaccaattcctccctgaagctgagctctgtgaccgccgcagacacggctgtctattactgtgcgaggccccgagccgcagtggtctttttgtatgtcctttgatatggtggggccgaagggacaatggtaccg

SEQ ID NO: 459190 - DNA, 392 bp, Homo sapiens
  misc_feature: HEFZJCU01EYO2H.49.29.C07.1.454.heavy.3.raw
agtcgagagacacgaccggtgctcgatttagagtgctacgaagggaaagggcttgagtggattgggagtatatattttactgggacgtcctactacaacccgtccctcaagagtcgagtcaccatatcagaagacacatccaagaaccaattctccttgaagctgacctctgtgaccgccgcggacacggccgtgtattactgtggagttccagctgtcggatactactactactacggtgtggacgtctggggccaagggaccacggtcaccgtctcctcagcctccaccaagggcccatcggtcttccccctggcaccctcctccaagagcacctctgggggcacagcggccctgggctgcctggtcaaggactacttcctctctcgact

SEQ ID NO: 459191 - DNA, 525 bp, Homo sapiens
  misc_feature: HEFZJCU01AJSS7.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatccgggtcttccccctggccg

SEQ ID NO: 459192 - DNA, 379 bp, Homo sapiens; identical to SEQ ID NO: 444450
  misc_feature: HEFZJCU01EUB26.47.77.G11.1.454.heavy.3.raw

SEQ ID NO: 459193 - DNA, 465 bp, Homo sapiens
  misc_feature: HEFZJCU01D8UJ3.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagccgaggacacggccgtatattactgtgcgaaaggccagggtatagcagtggctggtaccaactggggccagggaaccctggtcaccgtctcctcagcctccaccaagggcccatcggtcttccccctggcaccctcctccaagagcacctctgggggcacagcggccctgggctgcctggtcaaggactacttccgagtagtaca

SEQ ID NO: 459194 - DNA, 522 bp, Homo sapiens
  misc_feature: HEFZJCU01ETCNI.53.10.A10.1.454.heavy.3.raw
cgcgtatacacacgaccggtgctcgatttagcgtcgatctcaggggtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagactcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccaggggggacctttggggtttcgacccctggggccagggaaccctggtcaccgtctcctcagcctccaccaagggcccatcggtcttccccctggcaccctcctccaagagca

SEQ ID NO: 459195 - DNA, 371 bp, Homo sapiens; identical to SEQ ID NO: 444919
  misc_feature: HEFZJCU01EAFF7.3.1.A01.1.454.heavy.3.raw

SEQ ID NO: 459196 - DNA, 514 bp, Homo sapiens
  misc_feature: HEFZJCU01CTH7P.7.71.G05.1.454.heavy.3.raw
cgtgtctctacacgaccggtgctcgatttagtgtcgtcgcaagagagagggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcctgtgcagcctctgggttcaccttcagtagctacggcatgcactgggtccgccaagctccaggcaagggattggagtgggtgcagttgttcatctgaggcagtgttcaatggtatgcagactccgtgaagggccgattcaccatctccagagacaattccaggaacacaatgtatttggaaatgaacagcctaagtcctgaggacacgggtgtagtactactgtacgaaggaggggggaaccagcgggagttccaagtacttcc

SEQ ID NO: 459197 - DNA, 506 bp, Homo sapiens
  misc_feature: HEFZJCU01C4QR7.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaactcctccaccggcacagcctacatggagctgagcagtctgacacctgacgacacggccgtctattactgtgcgagagccgcgaatatgtggtgcaaagatggtcgttgtttgttttggccggtgaactactggggccagggcaccctggtcaccgtctcctcagcttccaccaagggcccatcggtcttccccctggcgccctgctccaggagcacctctggggcacagcggcctgggctgcctggtcaggactacttcca

SEQ ID NO: 459198 - DNA, 418 bp, Homo sapiens; identical to SEQ ID NO: 446028
  misc_feature: HEFZJCU01CXJMA.16.28.C06.1.454.heavy.3.raw

SEQ ID NO: 459199 - DNA, 510 bp, Homo sapiens
  misc_feature: HEFZJCU01DXK1N.4.58.F03.1.454.heavy.3.raw
  modified_base (487)..(487): a, c, t, g, unknown or other
agcactgtagcacgaccggtgctcgatttagtctgatcgagaagggaaaggggacccaacaaccacatccctcctcagaagcccccagagcacaacgcctcaccatggactggacctggaggatcctctttttggtggcagcagccacaggtgcccattcccaggtccagcttgtgcagtctggggctgaggtgaagaagcctggggcctcagtgagggtttcctgcaaggcttctggatacaccttcagtagttatactatacactgggtgcgccaggcccccggacaaagccttgagtggatgggatcgatcaactctggcaatggcaacacaaaatattcacagaagttacagggcagagtcaccattaccagggacacatccgcgaacacagcctacagtggagctgagcagcctgacatctgaagacacggctgtgtattactgttcgacgacgggctagtcgtgggattctagttatagtnactcggtcgttcgtgggggccgg

SEQ ID NO: 459200 - DNA, 500 bp, Homo sapiens
  misc_feature: HEFZJCU01AQ66Q.7.85.H08.1.454.heavy.3.raw
cgtgtctctacacgaccggtgctcgatttagtatcactcagtcgcgggggctctcagagaggtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctgggggtccctgagactctcctgtgcagcctctggatttaccttcagtacttatggcatgaactgggtccgccaggctccagggaaggggctgcagtgggtttcacacattaatactggaagtaggaccataacttacacagactctgtgaagggccgattcaccacctccagagacgacgccaagaactcactgtctctgcaaatgaacagcctgagagtcgaggacacggctgtgtattactgtgcgagagatccgggaggggacgtatgacc

SEQ ID NO: 459201 - DNA, 491 bp, Homo sapiens; identical to SEQ ID NO: 447981
  misc_feature: HEFZJCU01E1BD0.47.85.H08.1.454.heavy.3.raw

SEQ ID NO: 459202 - DNA, 508 bp, Homo sapiens
  misc_feature: HEFZJCU01ECKZ3.7.71.G05.1.454.heavy.3.raw
cgtgtctctacacgaccggtgctcgatttagtgtcgtcgcaagagagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgagggcagtgttcaatggtatgcagactccgtgaagggccattcaccatctccagagacaattccaggaacacaatgtatttggaaatgaacagcctaagtcctgaggacacgggtgtatactactgtacgaaggaggggggaaccgagcgggagttccaagtactcctttgacgtc

SEQ ID NO: 459203 - DNA, 525 bp, Homo sapiens
  misc_feature: HEFZJCU01COAUG.48.12.B01.1.454.heavy.3.raw
agtatacatacacgaccggtgctcgatttagtagtgtagattccgcggggatgctttctgagagtcatggatctcatgtgcaagaaaatgaagcacctgtggttcttcctcctgctggtggcgtctcccagatgggtcctgtcccagctgcacctgcaggagtcgggcccaggactggtgaggccttcggagaccctgtccctcacctgcactgtctctggtgactccatcaacagtggtacttttactactggggctggatccgccagaccccagggaagggtctggagtggattgggagtgtctattctagtgggaacacccactacaatccgtccctcaagagtcgagtcaccatatccgtggacacgtccaagaacgagttctcctgaggttacaatctgtgaccgccgcagacacggctgtatattactgtgcgagacaccgggagggggcgttactatggatcgggcgggaggttactactttgactactggggtccaggggagtcctggtcaccgtct

SEQ ID NO: 459204 - DNA, 509 bp, Homo sapiens
  misc_feature: HEFZJCU01D43JY.2.16.B05.1.454.heavy.3.raw
acgctcgacacacgaccggtgctcgatttagagctcacgtattgggtttgaggtctcagagaggagccttagccctggactccaaggcctttccacttggtgatcagcactgagcacagaggactcaccatggaattggggctgagctgggttttccttgttgccattttagaaggtgtccagtgtgaggtgcagctggtggagtctgggggaggtttggtccagcctggggggtccctgagactctcgtgtgcggcctctggattcatctctacaaactattggatgagctgggtccgtcaggctccagggaaggggctggagtgggtggccagcatgaacggagatggaagtcaaaagaactatgtggactctgtgaagggccgattcaccatctccagagacaacgccaagaactcactgtatctgcaaatgaacagcctaagacccgaggacacggctgtgtattactgtgcgagagaccgctacgtggggcccggagccctggt

SEQ ID NO: 459205 - DNA, 498 bp, Homo sapiens; identical to SEQ ID NO: 448922
  misc_feature: HEFZJCU01DERBI.11.73.G07.1.454.heavy.3.raw

SEQ ID NO: 459206 - DNA, 535 bp, Homo sapiens
  misc_feature: HEFZJCU01BX4N9.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaagggctggagtgggtggccaacataaagcaagatggaactgccgagtttacgtggactctgtgaagggccgtttcaccatctccagagacaacgccaagaattcactgtatctacaactgaacagcctgagagtcgcagacacggccgtgtattactgtgcgagatgtggaaaaagtatggctgtgtttattgggggccaggggagccctggtcaccgg

SEQ ID NO: 459207 - DNA, 503 bp, Homo sapiens
  misc_feature: HEFZJCU01BRCO3.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtgttagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactgggccagggaaccctggtcaccgtctcctcaacctccaccaagggcccatcggtcttccccctggcaccctcctccaagagcacctctgggggcacagcggccctgggctgcctggtcaaggactacttccgctacgtaga

SEQ ID NO: 459208 - DNA, 396 bp, Homo sapiens; identical to SEQ ID NO: 444469
  misc_feature: HEFZJCU01A85XL.47.46.E02.1.454.heavy.3.raw

SEQ ID NO: 459209 - DNA, 506 bp, Homo sapiens; identical to SEQ ID NO: 446520
  misc_feature: HEFZJCU01COZ05.10.38.D05.1.454.heavy.3.raw

SEQ ID NO: 459210 - DNA, 496 bp, Homo sapiens; identical to SEQ ID NO: 444697
  misc_feature: HEFZJCU01B2A8F.16.37.D04.1.454.heavy.3.raw

SEQ ID NO: 459211 - DNA, 524 bp, Homo sapiens
  misc_feature: HEFZJCU01BZILN.52.81.H04.1.454.heavy.3.raw
cgcagtacgacacgaccggtgctcgatttagtagtgtagattcgcgggggctctgggagaggagccccagccgtgagattcccaggagtttccacttggtgatcagcactgaacacagaccaccaaccatggagtttgggcttagctgggttttccttgttgctattttaaaaggtgcccaatgtgaggtgcagctggtggagtctgggggaggcttggtgcagccagggcggtccctgagactctcctgttcagcttccggagtcacctttggtcattatgctatgaactgggtccgccaggctccagggaagggcctgtcttgggtaggtttcattagaggcgacgcttttggtgggacaacagaatacgccgcgtctgtgaaaggcagattcaccatctcaagagatgattccaaaagcgtcgtctacttgcaaatgaacagcctgaaatccgaggacacagccgtgtattactgtactagagagtaattggatcggggaaaattactaactccggtatgg

SEQ ID NO: 459212 - DNA, 496 bp, Homo sapiens
  misc_feature: HEFZJCU01CTR71.40.42.D09.1.454.heavy.3.raw
tctagcgactcacgaccggtgctcgatttagacacatacgcagggaaaggggaagcatcatccaacaaccacatcccttctctacagaagcctctgagaggaaagttcttcaccatggactggacctggagggtcttctgcttgctggctgtagctccaggtgctcactcccaggtgcagctggtgcagtctggggctgaggtgaagaaccctggggcctcagtgaaggtttcctgcaaggcatctggatacaccttcaccaggtattttatgcactgggtgcgacaggccccgggacaagggcttgagtggatgggcataatcaaccaagtggtggtagcacaacctacacacagaagttccagggcagagtcaccgtgaccagcgacacgtccacgactacagtctacatgcaactgagcagcctgaggtctgaggacacgggccgtgtattactgtgcgagagatgatactagtggttattacttaaataagt

SEQ ID NO: 459213 - DNA, 313 bp, Homo sapiens; identical to SEQ ID NO: 444518
  misc_feature: HEFZJCU01AEQEK.7.10.A10.1.454.heavy.3.raw

SEQ ID NO: 459214 - DNA, 499 bp, Homo sapiens
  misc_feature: HEFZJCU01CDZOC.48.59.F04.1.454.heavy.3.raw
agtatacatacacgaccggtgctcgatttagtacacacacttaagggattgggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaagggctggagtggattgggagtatttaccacagtgggagcacctactacaacccgtccctccaaaagtcgaggcaccatatccgtagacacgtccaagaaccaattctccctgaagctgagctctgtgaccgccgcagacacggctgtctattactgtgcgaggcccgagcgcagtggcttttgatgccttgatatgtgggccagggacaatgtcaccgt

SEQ ID NO: 459215 - DNA, 400 bp, Homo sapiens; identical to SEQ ID NO: 444452
  misc_feature: HEFZJCU01BE2M4.47.24.C02.1.454.heavy.3.raw

SEQ ID NO: 459216 - DNA, 498 bp, Homo sapiens
  misc_feature: HEFZJCU01CNUG5.48.23.C01.1.454.heavy.3.raw
agtatacatacacgaccggtgctcgatttagtacacgtgattagggattggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgattgccttttgatatggtggggccgaagggac

SEQ ID NO: 459217 - DNA, 507 bp, Homo sapiens
  misc_feature: HEFZJCU01BQEIG.10.38.D05.1.454.heavy.3.raw
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgcctcaattctggggccagggacg

SEQ ID NO: 459218 - DNA, 497 bp, Homo sapiens
  misc_feature: HEFZJCU01B9YOC.4.75.G09.1.454.heavy.3.raw
agcactgtagcacgaccggtgctcgatttagtatagacatcagggtcttcgtgactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcagcactagcggagtgggtgtgggctggatccgtcagcccccaggaaaggccctggagtggcttgcactcatttattgggatgatgataagcgctacagcccatctctgatgaacaggctcaccatcaccaaggacgcctccaaaaaccaggtggtccttacaatgaccaacatggaccctgtggacacagccacatattactgtgcacagagatacgggcagcacgtggtttggggctacgtggggccagggaaccctggtcaccgtctcctcagcctccaccg

SEQ ID NO: 459219 - DNA, 509 bp, Homo sapiens
  misc_feature: HEFZJCU01BLG1F.52.71.G05.1.454.heavy.3.raw
cgcagtacgacacgaccggtgctcgatttagtgtcgtcgcaagagagaggggggctctgagagaggagcccagccctgggattttcaggtgttttcatttggtgatcaggactgaacagagagaaatcaccatggagtttgggctgagctggctttttcttgtggctattttaaaaggtggccaatgtgaggtgcagctggtggagtctgggggaggcttggtacagcccggggggtccctgagactctcctgtgcagcctctggattcagttttaccagctatgccatggcctgggtccgccaggctccagggaaggggctggagtgggtctcaggtattagtggtagtgctatgaccacattctacgcagactccgtgaagggccggttcaccatttccagagacaattccaagagtaccctgtatctgcaaatgaacagcctgagagccgacgacacggccgtatattactgtgcgaagcaattactctatggacattatgggccc

SEQ ID NO: 459220 - DNA, 478 bp, Homo sapiens
  misc_feature: HEFZJCU01BTIJ4.16.10.A10.1.454.heavy.3.raw
tgtactactccacgaccggtgctcgatttagcgtcgatctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtccaaggactacttccgagtagtaca

SEQ ID NO: 459221 - DNA, 499 bp, Homo sapiens
  misc_feature: HEFZJCU01C9FIP.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaaagatttactatagaggtgactacgggggcgttcg

SEQ ID NO: 459222 - DNA, 505 bp, Homo sapiens; identical to SEQ ID NO: 447076
  misc_feature: HEFZJCU01ENGI3.10.38.D05.1.454.heavy.3.raw

SEQ ID NO: 459223 - DNA, 509 bp, Homo sapiens
  misc_feature: HEFZJCU01DXAIX.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccagggactctggtcaccgtctccgcagcctccaccaggcc

SEQ ID NO: 459224 - DNA, 516 bp, Homo sapiens
  misc_feature: HEFZJCU01DX6BS.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagcgtgcgttttcttaggtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgaacacgggccatatattactgtgcgaaaggcaccggcagttagtcacccatactactttgaactactggggccg

SEQ ID NO: 459225 - DNA, 528 bp, Homo sapiens
  misc_feature: HEFZJCU01EEA1S.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgtagagcgtcgtctgtcagtggaattggctactgggcagggaacctggtcaccgtctcctcagcctccaccaacgg

SEQ ID NO: 459226 - DNA, 487 bp, Homo sapiens
  misc_feature: HEFZJCU01DPW56.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaatatactatggagactccttcaagggccgattcaccatctccagagacaattccaagaacatggtgtatctgcaatgaccagcctgagagccgaggacacgggtgtttatactgtgggagaaatccta

SEQ ID NO: 459227 - DNA, 512 bp, Homo sapiens
  misc_feature: HEFZJCU01ASS9Y.13.67.G01.1.454.heavy.3.raw
tcacgtactacacgaccggtgctcgatttagagtatacataggggggttgggtttggggtctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaaggcctggagtgggtctcaggtattagttggaatagtggtagcataggctatgcggactctgtgaagggccgattcaccatctccagagacaacgccaagaactccctgtatctgcaaatgaacagcctgagagctgaggacacggccttgtattattgtgcaaaagatccaaccccttacgatttttggta

SEQ ID NO: 459228 - DNA, 531 bp, Homo sapiens
  misc_feature: HEFZJCU01CT8OJ.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaacaacctgagagccgacgacacggccgtttattactgtgcgagagattcgagtggttcggggacctcaccctggttctacttcgatctctggggccgtggctacccg

SEQ ID NO: 459229 - DNA, 530 bp, Homo sapiens
  misc_feature: HEFZJCU01DWMJ1.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttggggccagggaaccctggtcaccgtctcctcagcctccaccaaggcccatcggtcttcccctggcaccctcctccaagagcacctctgggggcacagcggccctgggctgcct

SEQ ID NO: 459230 - DNA, 518 bp, Homo sapiens
  misc_feature: HEFZJCU01BE1KW.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaaggaggggggaaccaggcgggagttccaagtactcctttgacgtctc

SEQ ID NO: 459231 - DNA, 502 bp, Homo sapiens
  misc_feature: HEFZJCU01DTIKT.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataacacagcctacatggagttgaggagcctgacatctgacgacacggccgtctattactgtgcgagagtcccacgatccggtgagcctacggcagcggcctttgacttctc

SEQ ID NO: 459232 - DNA, 518 bp, Homo sapiens
  misc_feature: HEFZJCU01C6LTE.17.33.C11.1.454.heavy.3.raw
cgtagactagcacgaccggtgctcgatttagagtgagctcgttgggtttgggggactcctgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaaggccctggagtggcttgcgctcatttattgggatgagagtaagcactacagtccgtctctgaagaacaggctcaccatcaccaaggacacctccacaaaccaggtggtccttacaatgaccaatatggaccctgtggacacagccacatattactgttcacgctctatggttcggggagttattagtccctactttgactactggggccaggggaactctggtcaccgtctccgcagcctccaccaagggcccatcc

SEQ ID NO: 459233 - DNA, 387 bp, Homo sapiens; identical to SEQ ID NO: 444930
  misc_feature: HEFZJCU01CQ83E.16.59.F04.1.454.heavy.3.raw

SEQ ID NO: 459234 - DNA, 510 bp, Homo sapiens; identical to SEQ ID NO: 449925
  misc_feature: HEFZJCU01C91MP.17.25.C03.1.454.heavy.3.raw

SEQ ID NO: 459235 - DNA, 510 bp, Homo sapiens
  misc_feature: HEFZJCU01DYBZD.7.71.G05.1.454.heavy.3.raw
cgtgtctctacacgaccggtgctcgatttagtgtcgtcgcaagagagaggggggggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtggtccagcctgggaggtcacagagactctcctgtgcagcctctgggttcaccttcagtagctacggcatgcactgggtccgccaagctccaggcaagggattggagtgggtggcagttgtttcatctgaggcagtgttcaatggtatgcagactccgtgaagggccgattcaccatctccagagacaattccaggaacacaatgtatttggaatgaacagcctaagtcctgaggacacgggtgtatactactgtacgaaggagggggaaccagcgggagtccaagtactcctttg

SEQ ID NO: 459236 - DNA, 396 bp, Homo sapiens; identical to SEQ ID NO: 444469
  misc_feature: HEFZJCU01B9DEG.47.46.E02.1.454.heavy.3.raw

SEQ ID NO: 459237 - DNA, 492 bp, Homo sapiens
  misc_feature: HEFZJCU01EGH9B.52.76.G10.1.454.heavy.3.raw
cgcagtacgacacgaccggtgctcgatttagtcactcatacagggggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggaggcgtggtccagcctgggaggtccctgagactctcctgtgcaggctctgcatttcccttcaataactatgctatcgattgggtccgccaggctccaggcaagggactggagtgggtggcagtaatatcagctgatgggaggcactaaatattacgcagattctgcgaggggccgattcaccatatccagagacaactcccaagatatgatataatctacaaatgaacagcctgagacctgaggacacggctgtatattactgtgcgtcgagggggcagtgcctggcctacg

SEQ ID NO: 459238 - DNA, 526 bp, Homo sapiens; identical to SEQ ID NO: 453472
  misc_feature: HEFZJCU01AE8FL.18.33.C11.1.454.heavy.3.raw

SEQ ID NO: 459239 - DNA, 549 bp, Homo sapiens
  misc_feature: HEFZJCU01CBSTT.7.70.G04.1.454.heavy.3.raw
cgtgtctctacacgaccggtgctcgatttagtgtagtgtgaagggaaagggtctgtgaaggcttcaccagtcctggacctcctgtgcaagaacatgaaacacctgtggttcttcctcctgctggtggcaactcccagatgggtcctgtcccaggtgcagctgcaggagtcgggcccaggactggtgaagccttcacagaccctgtccctcacctgcactgtctctggtgactccatcagtaatggtggctactactggagctggattcgccagcacccggggaagggcctggagtggattggatacatctattactttgggagcacctactacaacccgtccctcaagagtcgagtaacgatctcagtggacacgtctaacaatcacctctcctgaggctgagctctgtgacagccgcggacacgggcgtttaattctgtgcgagaggggacggactacgggtagacgtacgttggggggttccgaaccccgtgggggcccgaggggaacccttgggtccaccggttctccctcacgcctcccaacccg

SEQ ID NO: 459240 - DNA, 501 bp, Homo sapiens; identical to SEQ ID NO: 455100
  misc_feature: HEFZJCU01ANQB6.10.38.D05.1.454.heavy.3.raw

SEQ ID NO: 459241 - DNA, 491 bp, Homo sapiens
  misc_feature: HEFZJCU01AP5HC.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattc

SEQ ID NO: 459242 - DNA, 520 bp, Homo sapiens
  misc_feature: HEFZJCU01DDY4I.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaagggcccatcggtcttcccctgcg

SEQ ID NO: 459243 - DNA, 521 bp, Homo sapiens
  misc_feature: HEFZJCU01C602W.12.40.D07.1.454.heavy.3.raw
  modified_base (480)..(480): a, c, t, g, unknown or other
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtntccccagcctccaccaagggcccatcggtcttcccctggcg

SEQ ID NO: 459244 - DNA, 520 bp, Homo sapiens
  misc_feature: HEFZJCU01BLNQQ.22.73.G07.1.454.heavy.3.raw
acatacgcgtcacgaccggtgctcgatttagctctacgctcagggtctccgaaggcttcaccagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtccccagggaagggactggagtggattggggtatatctattacactgggagcaccgactacagcccctccctcatgagtcgagtcaccatttcactagacacgtccaagaaccagttctccctgaaactgaggtctgtgaccgctgcggacacggccgtctattactgtgtcgagatttgctttttgggagtggttacgccgcgttttgactactggggccagggaaccctggtcaccgtctcctcagcctccaccaac

SEQ ID NO: 459245 - DNA, 485 bp, Homo sapiens; identical to SEQ ID NO: 444908
  misc_feature: HEFZJCU01C7ANP.12.40.D07.1.454.heavy.3.raw

SEQ ID NO: 459246 - DNA, 484 bp, Homo sapiens; identical to SEQ ID NO: 445311
  misc_feature: HEFZJCU01CSUZ8.11.23.C01.1.454.heavy.3.raw

SEQ ID NO: 459247 - DNA, 396 bp, Homo sapiens; identical to SEQ ID NO: 444469
  misc_feature: HEFZJCU01CP7CU.47.46.E02.1.454.heavy.3.raw

SEQ ID NO: 459248 - DNA, 541 bp, Homo sapiens
  misc_feature: HEFZJCU01BK26Q.52.34.D01.1.454.heavy.3.raw
cgcagtacgacacgaccggtgctcgatttagatcgtctgtgttgggtttgggctgagctggctctttcttgtggctattttaaaaggtgtccagtgtgacgtacagctggtggagtcggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttattactgtgcgaaagatcgaggtcgcatgacagtttttggagtggccaaagacggcaggttccgctacgggttggacgtctggggccaagggaccacggtcaccgtcgcctcagcctccaccaagggcccatcggtccttccccctggccaccctcctccaaga

SEQ ID NO: 459249 - DNA, 530 bp, Homo sapiens
  misc_feature: HEFZJCU01DM0DI.11.85.H08.1.454.heavy.3.raw
cgagagataccacgaccggtgctcgatttagtatcactcagtcgcggggtcctggacctcctgtgcaagaccatgaaacacctgttgttcttcctcctgctggtggcagctcccaaatgggtcctgtcccaggtacacctggtggagacgggcccaggactggtgaagccttcacagacgctgtccctcacctgcaatgtctccggagtctccatcaccgatactgattactactggctttggatccgacagtccccagggaagggcctggagtggcttggttatgtccaccacagagggatcccttactacaacccgtcactcaagagtcgacttaccatatcactcgacacgtccaggaatcagttctccctgaaactgaggtccgtcattgtcgcggacacagccgtctattattgtgtcagagatccggcccataactggctcggccctgggcccggaaccctggtcaccgtctcctcagcctccaccaacgggcccatccggtcttcccctggccaccctcctcc

SEQ ID NO: 459250 - DNA, 470 bp, Homo sapiens; identical to SEQ ID NO: 444866
  misc_feature: HEFZJCU01BB0ZW.4.36.D03.1.454.heavy.3.raw

SEQ ID NO: 459251 - DNA, 488 bp, Homo sapiens
  misc_feature: HEFZJCU01B4UXJ.53.56.F01.1.454.heavy.3.raw
cgcgtatacacacgaccggtgctcgatttagcagacgtctgaacacacaaagggggagcatcacccagcaaccacatctgtcctccagagaatcccctgagagctccgttcctcaccatggactggacctggaggatcctcttcttggtggcagcagccacaggagcccactcccaggtgaaattgctgcagtctggggctgaggtgaagaagcctggggcctcagtgaaggtctcctgcaagacttctggatacatcttcaccgactactatgttcactgggtgcgacaggcccctggacaaggacttgagtggatgggatggttcaaccctgacactggtgtcgcaacctatgcacagaggtttcagggcagggtcaccatgaccagggacacgtccatcagcacagcctacatggagctacacggcctgagatctgacgacacggccctgtatttttgtgtcgagagagtctattaaagtggctt

SEQ ID NO: 459252 - DNA, 521 bp, Homo sapiens
  misc_feature: HEFZJCU01AVS15.16.10.A10.1.454.heavy.3.raw
tgtactactccacgaccggtgctcgatttagcgtcgatctcagggtcttcgtggctcacgtccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaacgggcccatcggtcttccccctggccaccctcctccaagagcacctctgggggcacagcggccctgggctgcctggtcaaggactacttccgagtagtaca

SEQ ID NO: 459253 - DNA, 521 bp, Homo sapiens
  misc_feature: HEFZJCU01CC6JQ.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctgggggccaggggaccctggtcatcgtctccccagcctccaccaagggcccatcggtctcccctggcg

SEQ ID NO: 459254 - DNA, 376 bp, Homo sapiens; identical to SEQ ID NO: 448109
  misc_feature: HEFZJCU01BXBW7.49.72.G06.1.454.heavy.3.raw

SEQ ID NO: 459255 - DNA, 500 bp, Homo sapiens
  misc_feature: HEFZJCU01AWRPR.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagccggccctgggctgcctggtcaaggacttaccg

SEQ ID NO: 459256 - DNA, 519 bp, Homo sapiens
  misc_feature: HEFZJCU01CK855.47.64.F09.1.454.heavy.3.raw
  modified_base (508)..(508): a, c, t, g, unknown or other
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagtacggttttgatatttggggccaagggacaagggtcacgtctccgnagcctccaccg

SEQ ID NO: 459257 - DNA, 512 bp, Homo sapiens
  misc_feature: HEFZJCU01EJUJG.11.13.B02.1.454.heavy.3.raw
  modified_base (500)..(500): a, c, t, g, unknown or other
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacngcgcctggctcg

SEQ ID NO: 459258 - DNA, 529 bp, Homo sapiens
  misc_feature: HEFZJCU01CUZC0.13.6.A06.1.454.heavy.3.raw
tcacgtactacacgaccggtgctcgatttagatctactgacagggtctccgaaggcttcaccagtcctgtcccaggtgcagctgcgggagtcgggcccaggactggtgaagccttcggagaccctgtccctcacctgcactgtctctggtggctccatcagtagttactactggagctggatccggcagcccccagggaagggactggagtggattgggcatatcttttacagtgggagcaccaactacaacccctccctcaagagtcgagtcaccatatcagtggacacgtccaagaaccagttctccctgaagctgagctctgtgaccgctgcggacacggccgtgtattactgtgcgagctggggttcagggtactttgactactgggccagggaaccctggtcaccgtctcctcagcctccaccaagggcccatcggtcttccccctggcaccctcctccaagagcacctctgggggcacagcggcctgggctgcctggtcaaggactacttcctagtacgtgac

SEQ ID NO: 459259 - DNA, 506 bp, Homo sapiens; identical to SEQ ID NO: 445156
  misc_feature: HEFZJCU01DE4JT.48.44.D11.1.454.heavy.3.raw

SEQ ID NO: 459260 - DNA, 390 bp, Homo sapiens; identical to SEQ ID NO: 444541
  misc_feature: HEFZJCU01DDW34.16.24.C02.1.454.heavy.3.raw

SEQ ID NO: 459261 - DNA, 500 bp, Homo sapiens
  misc_feature: HEFZJCU01D22GP.12.38.D05.1.454.heavy.3.raw
atacgacgtacacgaccggtgctcgatttagtatctgatagttgggtctgggggagacttagtaaagcctggagggtccctgagactgtcctgtgcagcttctggattcactttcaacaatcacgggatgaactgggtccgccaggctccagggaaggggctggagtgggtttcatacatcactgctactagtagtaccacatactatgcagactcggtgaagggccgattcaccatctccagagacaacgccaagaactcactgtatttacacatggacggactgagagtcgaggacacggctgtttattactgtgcgagaactggaatcggaggatatagaggctatttagattcctggggccagggaagcctggtcaccgtctcctcagcctccaccaagggccatcggtcttcccctggcgccctgctccaggagcacctccgagagcacagccggcccgtgggctgcctggtcaaggactactcctacgtcgtat

SEQ ID NO: 459262 - DNA, 521 bp, Homo sapiens; identical to SEQ ID NO: 445317
  misc_feature: HEFZJCU01BG2GY.12.40.D07.1.454.heavy.3.raw

SEQ ID NO: 459263 - DNA, 469 bp, Homo sapiens
  misc_feature: HEFZJCU01EHCKK.4.36.D03.1.454.heavy.3.raw
agcactgtagcacgaccggtgctcgatttagctgcgtcacgatctctcctgtgtagcctctggattcacctttgacacctattggatgacctgggtccgccagtctccagggaaggggctggagtgggtggccaacattcggcgagatggaattgtgacacactatatggactctgtggagggccgattcaccatctccagagacaaccccaagaactcactctttctgcaaatgaacagcctgagagccgaggacacggctatgtatttctgtgctcgggatttctccccggacactgcggtggcagggtatgatgcatttgatatctggggccaagggcaatggtcaccgtctcttcagcctccaccaagggcccatcggtcttcccctggcgccctgctccaggagcacctccgagagcacagcggccctgggctgcctggtcaaggactacttccctacagtgct

SEQ ID NO: 459264 - DNA, 525 bp, Homo sapiens; identical to SEQ ID NO: 450208
  misc_feature: HEFZJCU01A2GWC.3.82.H05.1.454.heavy.3.raw

SEQ ID NO: 459265 - DNA, 521 bp, Homo sapiens; identical to SEQ ID NO: 445317
  misc_feature: HEFZJCU01BIN4E.12.40.D07.1.454.heavy.3.raw

SEQ ID NO: 459266 - DNA, 482 bp, Homo sapiens; identical to SEQ ID NO: 444503
  misc_feature: HEFZJCU01CQHQA.7.10.A10.1.454.heavy.3.raw

SEQ ID NO: 459267 - DNA, 403 bp, Homo sapiens; identical to SEQ ID NO: 445029
  misc_feature: HEFZJCU01A9BEG.10.77.G11.1.454.heavy.3.raw

SEQ ID NO: 459268 - DNA, 423 bp, Homo sapiens; identical to SEQ ID NO: 444772
  misc_feature: HEFZJCU01B8WLS.16.78.H01.1.454.heavy.3.raw

SEQ ID NO: 459269 - DNA, 497 bp, Homo sapiens
  misc_feature: HEFZJCU01B11AD.51.27.C05.1.454.heavy.3.raw
cgatcgtatacacgaccggtgctcgatttagacgcgatcgaagggtttgggggggagacgagcccagcactggaagtcgccggtgtttccattcggtgatcatcactgaacacagaggactcaccatggagtttgggctgagctgggttttcctcgttgctcttttaagaggtgtccagtgttatgtgcagctggtggagtctgggggaggcgtggtccagcctgggaggtccctgagactcgcctgtacaccctctggattcaccttcagtaactatgcaatgcactgggtccgccaggctccaggcaaggggctggactgggtggcaggtatatcatatgatggaagcaataaatactacgcagactccgtgaagggccgattcaccatcctccagagacagttccgatgacacagtctatctgcaaatgaacagcctgagagctgaggacacggctctttttactgttgccgccaggaagcagtggctggccac

SEQ ID NO: 459270 - DNA, 501 bp, Homo sapiens
  misc_feature: HEFZJCU01DHTKN.52.20.B09.1.454.heavy.3.raw
  modified_base (449)..(449): a, c, t, g, unknown or other
cgcagtacgacacgaccggtgctcgatttagtgtagtgtgaaggggctgggagacgagcccagcactggaagtcgccggtgtttccattcggtgatcatcactgaacacagaggactcaccatggagtttgggctgagctgggttttcctcgttgctcttttaagaggcgtccagtgttatgtgcagctggtggagtctgggggaggcgtggtccagcctgggaggtccctgagactcgcctgtaaaccgtccggatttaccttcagtaactatgcaatgcactgggtccgccaggctccaggcaaggggctggactgggtggcagctatatcatttgatggaagcaataatactacgcagactccgtgaagggccgattcaccatttccagagacagctccgataacacggtctatctgcgaatgaacagcctgagacctgaggaacncggctctttttactgtgcgccaggaagcagtggctggccacatgatgctttt

SEQ ID NO: 459271 - DNA, 501 bp, Homo sapiens
  misc_feature: HEFZJCU01C1VD1.26.37.D04.1.454.heavy.3.raw
agactatactcacgaccggtgctcgatttagtagcatactgttgggtttggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggagcaggtagtggagtctgggggaggcgtggtccagcctggggggtccctgagactctcctgtgcagcctctggattcaccttcagtacctacgccatgcactggatccgccaggctccaggcaaggggctagagtgggtggctcttatatcatatgatggaagtaatgaacattacgcagactccgtgaagggccgattcaccgtctccagagacaattccaagagcacgatgttctgcaaatgaacagcctgagagttgaggacacgggtgtctatttctgtgcgcgagtccggtgaggggtgtcca

SEQ ID NO: 459272 - DNA, 427 bp, Homo sapiens; identical to SEQ ID NO: 444708
  misc_feature: HEFZJCU01DFKF9.9.34.D01.1.454.heavy.3.raw

SEQ ID NO: 459273 - DNA, 493 bp, Homo sapiens
  misc_feature: HEFZJCU01D7TTD.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaaggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaacgggcccatcggtcttcccctggcgccctgctccaggagcacctccgagagcacagcggcccgtgggctgcctggtcaacggactacttcccacgagagta

SEQ ID NO: 459274 - DNA, 483 bp, Homo sapiens
  misc_feature: HEFZJCU01EMA36.11.23.C01.1.454.heavy.3.raw
cgagagataccacgaccggtgctcgatttagtacacgtgattagggattgggggcagggtgtacacctgtggttctcggggctgccctttggctttggagatggttttctcgatgggggctggagtggcttgggcgctctagaaacaaggttgccagtcataccacagaatatgccgcgactgtgaagggcagagtcaccatctcaagagatgattcaacgaattcactgtatctccaaatggacagtctgaaaaccgaagacacgggcgtgtatttttgtgccagagaagaggggatattgctctgatggtgtctgctattacgtctacggtttggacgttctggggccaagggaccacggtcatcgtctcctcagcctcaccaagggcccatcggtcttcccctggcaccctcctccaagagcacctctgggggcacagcggccctgggctgcctggtcaggactacttccgtatctctcg

SEQ ID NO: 459275 - DNA, 502 bp, Homo sapiens
  misc_feature: HEFZJCU01EI2FC.51.82.H05.1.454.heavy.3.raw
cgatcgtatacacgaccggtgctcgatttagtcgagctctctcgcgggcacgaccggtgctcgatttagtacacacacttagggattggggtctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatt

SEQ ID NO: 459276 - DNA, 464 bp, Homo sapiens; identical to SEQ ID NO: 445062
  misc_feature: HEFZJCU01DNRTR.19.10.A10.1.454.heavy.3.raw

SEQ ID NO: 459277 - DNA, 512 bp, Homo sapiens
  misc_feature: HEFZJCU01D78VC.17.25.C03.1.454.heavy.3.raw
  modified_base (452)..(452): a, c, t, g, unknown or other
  modified_base (470)..(470): a, c, t, g, unknown or other
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaacctcctccataaacacagcctacatggagttgaggagcctgacatctgacgacacggccgtctattacngtgcgagagtcccaacgntccggtgacgccgtacggcaggcggtcctttgacctttcgtc

SEQ ID NO: 459278 - DNA, 497 bp, Homo sapiens; identical to SEQ ID NO: 447711
  misc_feature: HEFZJCU01EA1H4.16.37.D04.1.454.heavy.3.raw

SEQ ID NO: 459279 - DNA, 531 bp, Homo sapiens; identical to SEQ ID NO: 446857
  misc_feature: HEFZJCU01B5VHP.7.78.H01.1.454.heavy.3.raw

SEQ ID NO: 459280 - DNA, 513 bp, Homo sapiens
  misc_feature: HEFZJCU01B8FXJ.48.78.H01.1.454.heavy.3.raw
agtatacatacacgaccggtgctcgatttagtgtgagtagtttgggtttggggacccaaaaaccacacccctccttgggagaatcccctagatcacagctcctcaccatggactggacctggagcatccttttcttggtggcagcagcaacaggtgcccactcccaggttcaggtggtgcagtctggagctgaggtgaagaagcctggggcctcagtgaacgtctcctgcaaggcttctggttacacctttaccagctatgggatcagctgggtgcgacaggcccctggacaagggcttgagtggatgggatggatcaacgcttacaacggtaacacaaactatgcacagaagctccagggcagagtcaccatgaccacagacacatccacgagcacagcctacatggagctgaggagcctgagatctgacgacacggccgtgtattactgtgcgagagaagggttttactatgggttcgggagtctccgacccagcaactggttcgaccccg

SEQ ID NO: 459281 - DNA, 511 bp, Homo sapiens
  misc_feature: HEFZJCU01EHZDR.52.86.H09.1.454.heavy.3.raw
cgcagtacgacacgaccggtgctcgatttagtgctatagacttgggtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctgggggccaagggacaaatggtcattgtctcttcagcctccaccaagggcccatccggtctttcccccg

SEQ ID NO: 459282 - DNA, 491 bp, Homo sapiens; identical to SEQ ID NO: 444749
  misc_feature: HEFZJCU01CLICU.11.13.B02.1.454.heavy.3.raw

SEQ ID NO: 459283 - DNA, 465 bp, Homo sapiens; identical to SEQ ID NO: 444805
  misc_feature: HEFZJCU01BB96N.19.10.A10.1.454.heavy.3.raw

SEQ ID NO: 459284 - DNA, 508 bp, Homo sapiens; identical to SEQ ID NO: 445594
  misc_feature: HEFZJCU01EWULV.17.25.C03.1.454.heavy.3.raw

SEQ ID NO: 459285 - DNA, 510 bp, Homo sapiens
  misc_feature: HEFZJCU01C1O8D.48.37.D04.1.454.heavy.3.raw
agtatacatacacgaccggtgctcgatttagtagcatactgtgggtttggggctgagctgggttttccttgttgccatattagaaggtgtccactgtgaggtgcagctggcggagtctgggggagacttggtacagcctggggagtccctgagactctcctgtgcagcctctggattcaccttcagtttgtttgacatgcactgggtccgccaggctccaggaaaaggtctggagtgggtctcagtcatgggtacagctggtcacacatactatgcagactccgtaaagggccgattcaccatctccagagaagacgccaagaattccttgtatcttcagatgaacagtctgagaaccgatgacacggctgtgtattattgtgcaaaagggggagcagctcgtccatccacttcgactcctggggccagggaaccctggtcaccgtctcctcagcctccaccaagggcccatcggtcttcccctggcaccctcctccaagagcacctctc

SEQ ID NO: 459286 - DNA, 453 bp, Homo sapiens
  misc_feature: HEFZJCU01ESY66.52.78.H01.1.454.heavy.3.raw
cgcagtacgacacgaccggtgctcgatttagtgtgagtagtttgggtttggggggaagaggaagactgacggtccccccaggagttcaggtgctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctacccggctgctacttcgatctctggggccgtggcaccctggtcactgtcttctcagcctccaccaagggcccatcggtcttcccctggcaccctcctccaagagcacctctgggggcacagcggccctgggctgcctggtcaaggactacttcctatacgatcg

SEQ ID NO: 459287 - DNA, 495 bp, Homo sapiens
  misc_feature: HEFZJCU01CPE6W.51.38.D05.1.454.heavy.3.raw
cgatcgtatacacgaccggtgctcgatttagtatctgatagttgggtttggggtctgggagacgagcccagcactggaagtcgccggtgtttccattcggtgatcatcactgaacacagaggactcaccatggagtttgggctgagcgtggttttcgtcgttaggctctttaagaggtgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcagggcatatcatttgatggaagcaagaagtactatgcagactccgtgaagggccgattcaccatctccagagacagttccgatgacacagtctatctacacatgagcagtgtgagacctgacgacacggctctttttactgtgcgccaggaagcagtgctgg

SEQ ID NO: 459288 - DNA, 507 bp, Homo sapiens
  misc_feature: HEFZJCU01EBZC1.49.38.D05.1.454.heavy.3.raw
agtcgagagacacgaccggtgctcgatttagtatctgatagttgggtttgggggaggcgtggtccagcctgggaggtccctgagactctcctgtgcagcctctggattcgtctctagtgtctaccctatgcactgggtccgccaggctccaggcaaggggctggaatgggtggcacttatctcatctgatggaaggtctgaatcttatgccgactccgtgaagggccgattcaccatctccagagacaattccaagaacacactatatcttcaaatgaacactctgagacgtgaggacacggctgtctattactgtgcgactgagatgtcttattacgatgccagtgctttagtaccgttcgacccctggggccagggagccctggtcaccgtctcctcagcttccaccaagggcccatcggtcttcccctggcgccctgctccaggagcacctctgggggcacagcggccctgggctgcctggtcaaggactacttcctctctcga

SEQ ID NO: 459289 - DNA, 498 bp, Homo sapiens; identical to SEQ ID NO: 445952
  misc_feature: HEFZJCU01CL1TR.11.71.G05.1.454.heavy.3.raw

SEQ ID NO: 459290 - DNA, 522 bp, Homo sapiens
  misc_feature: HEFZJCU01ASJZ6.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctgggtcatcgtctccccagcctccaccaagggcccatcggtcttcccctggcg

SEQ ID NO: 459291 - DNA, 500 bp, Homo sapiens
  misc_feature: HEFZJCU01ETO3G.40.81.H04.1.454.heavy.3.raw
tctagcgactcacgaccggtgctcgatttagtagtgtagattcgcggggagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaaccctaccagaggtggcacaaagtatcgacagaactttcagggcagggtcaccatgacctgggacgcgtccatcagcacagtctacatggatctgagcggactgacctctgacgacacggccatgtattactgtggaagagacgttggtggctaccgcggggctgaccacgtggggccg

SEQ ID NO: 459292 - DNA, 502 bp, Homo sapiens
  misc_feature: HEFZJCU01EWKSP.51.83.H06.1.454.heavy.3.raw
cgatcgtatacacgaccggtgctcgatttagatcacgtgcgtcgcggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgtagctggtggactctgggggaggcgtggtccagcctgggaggtccctgcgactctcctgtgcagcctctggattcagcttcagggctaatactatgttctgggtgcgccaggctccaggcaaggggctggagtgggtggcagtcatctggcctgatggaggtttaacatactatgcggactccgtggagggccgattcaccgtctccagagacaactccaaaaacacgctgtatctccaaatgaacagcctcagatctgaggacacggctatctactactgtgtgaaagaattgggtttcagtggctactttgta

SEQ ID NO: 459293 - DNA, 419 bp, Homo sapiens
  misc_feature: HEFZJCU01ANGZA.4.22.B11.1.454.heavy.3.raw
agcactgtagcacgaccggtgctcgatttagacgacagctcagggaaggggctggagtggattggtttcattagaagcaaaacttatggtgggacaccagaatatgccgcgtctgtgaaaggcagattcaccatctcaagagatgattccaaaagtgtcgcctacctccagatgactagcctgaagaccgaagactcagccctttattactgtgctagagatcgactggcccgttacgatttttggcgtggccccgacggaacatcctcagactcctggggtcagggaaccctggtcaccgtctcctcagcctccaccaagggcccatcggtcttccccctggcaccctcctccaagagcacctctgggggcacagcggccctgggctgcctggtcaaggactacttccctacagtgct

SEQ ID NO: 459294 - DNA, 528 bp, Homo sapiens
  misc_feature: HEFZJCU01DXA2A.51.78.H01.1.454.heavy.3.raw
cgatcgtatacacgaccggtgctcgatttagtgtgagtagtttgggtttggggatggtggcagctcccagatgggtcctgtcccaggtgcagctgcaggagtcgggcccaggactggtgaagccttcggagaccctgaccctcacctgtactgtgtctgatgactccatcgggagttactactggacctggatccggaagcccccagggaagggactggagtggattggatatatctattataatgggaggaccgagtacaacccctccctcaagagtcgagtcaccatatcagttgactcctccaagaaccagttctccctgaggctgaactctgtgacctctgcggacacggccatgtatttctgtgcgaaagttcaggccccatcttattatgacgctagtggttatcaaataggggcctactttgactactggggccgggggaacccaggtcaccgtctcctcagcctccaccaagggcccatcggtcttcccctggcacctcctccaagagcacctctggggc

SEQ ID NO: 459295 - DNA, 499 bp, Homo sapiens
  misc_feature: HEFZJCU01D3JW3.4.19.B08.1.454.heavy.3.raw
agcactgtagcacgaccggtgctcgatttagtgagtcagtaaggggtgggagaggagcccagcactggaagtcgccggtgtttccattcggtgatcagcactgaacacagaggactcaccatggagtttgggctgagctgggtcttcctcgttgttcttttaagaggtgtccagtgtcaggtgaaattggtggactctgggggaggcgtggtccagcctgggaggtccctgagactctcctgtatagcctctggattcaccttcggcagttatgctatgcactgggtccgccaggctccaggcaaggggttggagtgggtggcagcaatatcatatgatggaagtgataaatattacatagagtccgtgaagggtcgattcaccatctccagagacaatcgcaagaacacactgtatctggaaatgaccagcctgagaggtgacgacacgggtgttttattactgtgcgcgggatagaggctcatcgtggatacaactt

SEQ ID NO: 459296 - DNA, 516 bp, Homo sapiens
  misc_feature: HEFZJCU01EP6KK.48.38.D05.1.454.heavy.3.raw
agtatacatacacgaccggtgctcgatttagtatctgatagttgggtttggggacccaacaaccacacccctcctaagaagaagcccctagaccacagctccacaccatggactggacctggaggatcctcttcttggtggcagcagcaacaggtgcccactcccaggtgcagttggtgcaatctgggtctgatttgaagaagcctggggcctcagtgaaggtttcctgcagggcttctggatactccttcactgactatggtatcaattgggtgcgacaggcccctggccaagggcttgagtggatggggtggatcgacaccaacactgggaacccaacacatgcccggggcttcaaaggacggtttgacttctccttggccacctctgtcagcacggcatatctgcagatcagcagcctaaagcctgaggacactgccgtgttttattgtgcgagatccaggcgaggaggataccgattcttatatagcgactactactacttcggaatggacg

SEQ ID NO: 459297 - DNA, 380 bp, Homo sapiens
  misc_feature: HEFZJCU01BRBUI.13.42.D09.1.454.heavy.3.raw
tcacgtactacacgaccggtgctcgatttagacacatacgcagggaaaggggctggagtgggtggccaacataaacacagacggaagtgacccatactatgcggactctgtgaagggccgattcaccatctccagagacaacgccaagaactcactatatttgcaaattggaccgcctgagagacgaggacacggctatgtattactggtgcgagagatggagagtggctacagttggggccggggaaccctggtcaccgtcaactcagcctccaccaagggcccatcggtcttccccctggcgccctgctccaggagcaccgtccgacgagcacagcggccctgggctgcctggtcaaggactacttccgtactagacg

SEQ ID NO: 459298 - DNA, 512 bp, Homo sapiens
  misc_feature: HEFZJCU01BPD29.8.34.D01.1.454.heavy.3.raw
ctcgcgtgtccacgaccggtgctcgatttagatcgtctgtgttgggtctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtggtccagcctgggaggtcacagagactctcgtgtgcagcctctgggttcaccttcagtaactacggcatgcactgggtccgccaagctccaggcaagggattggagtgggtggcagttgtttcatctgagggcagtgttcaatggtatgcagactccgtgaagggccgattcaccatctccagagacaattccaggaacacaatgtatttggagctgaacagcctaagtcctgaggacacgggcgtatactactgtacgaagggaggggggaaccgaggcgggagttccaagtactcctttg

SEQ ID NO: 459299 - DNA, 396 bp, Homo sapiens; identical to SEQ ID NO: 444469
  misc_feature: HEFZJCU01C89WM.47.46.E02.1.454.heavy.3.raw

SEQ ID NO: 459300 - DNA, 509 bp, Homo sapiens; identical to SEQ ID NO: 444586
  misc_feature: HEFZJCU01EJRES.12.78.H01.1.454.heavy.3.raw

SEQ ID NO: 459301 - DNA, 512 bp, Homo sapiens
  misc_feature: HEFZJCU01EEKR4.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagcctacggcagcggccttttgactttcgtggggcccagggacg

SEQ ID NO: 459302 - DNA, 313 bp, Homo sapiens
  misc_feature: HEFZJCU01DYFZL.7.10.A10.1.454.heavy.3.raw
cgtgtctctacacgaccggtgctcgatttagcgtcgatctcagggacaacgccaagaagtcactgtatctacaaatgaacagcctgagagccgaggacacggccatgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttcctagagacacg

SEQ ID NO: 459303 - DNA, 418 bp, Homo sapiens
  misc_feature: HEFZJCU01E15K4.4.22.B11.1.454.heavy.3.raw
agcactgtagcacgaccggtgctcgatttagacgacagctcagggaaggggctggagtggattggtttcattagaagcaaaacttatggtgggacaccagaatatgccgcgtctgtgaaaggcagattcaccatctcaagagatgattccaaaagtgtcgcctacctccagatgactagcctgaagaccgaagactcagccctttattactgtgctagagatcgactggcccgttacgatttttggcgtggcccgacggaacatcctcagactcctggggtcagggaaccctggtcaccgtctcctcagcctccaccaagggcccatcggtcttccccctggcaccctcctccaagagcacctctgggggcacagcggccctgggctgcctggtcaaggactacttccctacagtgct

SEQ ID NO: 459304 - DNA, 504 bp, Homo sapiens
  misc_feature: HEFZJCU01CLCQ8.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccgttcaccctctccagagacacttccaacaacatcttgtatcttcacatgcacaatctgagagtcgacgacacggccacctattattgtgcgcgacatgactacgctcaattctggggccagggacg

SEQ ID NO: 459305 - DNA, 518 bp, Homo sapiens
  misc_feature: HEFZJCU01ETBWN.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtccagaaccagttctccctgacagtgagttatatgaccgccgcagacacggccgtgtattactgtgcgagagaggccgttattttaggaccagctagttaaaaactcctactacggtctggacgtctgtggccgaggggaccg

SEQ ID NO: 459306 - DNA, 493 bp, Homo sapiens
  misc_feature: HEFZJCU01DK880.48.47.E03.1.454.heavy.3.raw
agtatacatacacgaccggtgctcgatttagactcgcgcacagagagaagggacaaccacattcctcctctaaagaagtccctgggagcacagctcttcaccatggactggacctggaggttcctctttgtggtggcagcagcaacaggtgtccagtcccaggtgcggctggaacaatctggggccgaagtgaggaagcctgggtcctcagtgaagatctcctgcctggcctctggaggcaccttcaatcactatgctttcaactgggtgcgacaggtccctggacaaggacttgtgtggatggggggattcatccctatgtttaagagaatcaggcgtgctgagaagttcgaggacagagtcacctttatggcggacgaatcctcgagcacagtctatatggatctggccagcctgaagtctgaagacacgggcatatatttctgtgcgacagatggtcgtggattctcgtctgcttatggaggggaagact

SEQ ID NO: 459307 - DNA, 415 bp, Homo sapiens; identical to SEQ ID NO: 444794
  misc_feature: HEFZJCU01C2NLO.14.74.G08.1.454.heavy.3.raw

SEQ ID NO: 459308 - DNA, 396 bp, Homo sapiens; identical to SEQ ID NO: 444469
  misc_feature: HEFZJCU01BGEEZ.47.46.E02.1.454.heavy.3.raw

SEQ ID NO: 459309 - DNA, 523 bp, Homo sapiens
  misc_feature: HEFZJCU01E0ADG.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgccctgctccaggagcacctccg

SEQ ID NO: 459310 - DNA, 520 bp, Homo sapiens
  misc_feature: HEFZJCU01C2PL9.7.78.H01.1.454.heavy.3.raw
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacaggggcggtttgtcttctccatggatacctctgtcgggacggcttatctgcagataaccaaccttcaacctgacgacactgccgtttatttttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggactacttcctagagacacg

SEQ ID NO: 459311 - DNA, 514 bp, Homo sapiens
  misc_feature: HEFZJCU01CYFJY.13.21.B10.1.454.heavy.3.raw
tcacgtactacacgaccggtgctcgatttagtgtcgtcgcaaagagagaggagccttagccctggactccaaggcctttccacttggtgatcagcactgagcacagaggactcaccatggcattggggctgaactgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgccagactccagggaaggggctggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgtgagatgagagtggctacagttggggccggggaaccctggtcaccgtcaa

SEQ ID NO: 459312 - DNA, 522 bp, Homo sapiens
  misc_feature: HEFZJCU01CBE20.14.41.D08.1.454.heavy.3.raw
cgtctagtaccacgaccggtgctcgatttagtcacgcgagaaagggaaagggtctgtgaaggcttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaagggcctggagtggattggctacatctatcacagtgggagcacccactacaacccgtccctcaatagtcgacaaaccatatcagttgacacgtctaagaaccagttactccctgaagctgagctctgtgactgccgcggacacggccgtgtattactgtgcgaggtcgattgtgatggtaacaactagcttcttactcctttgaccagtggggccgggggaacccgtggtcaccgtctcttcagcctccaccaaggcccatcggtcttcccctggcaccctcctccaagagcacctctgggggcacagcc

SEQ ID NO: 459313 - DNA, 505 bp, Homo sapiens; identical to SEQ ID NO: 447124
  misc_feature: HEFZJCU01BRA86.10.88.H11.1.454.heavy.3.raw

SEQ ID NO: 459314 - DNA, 425 bp, Homo sapiens
  misc_feature: HEFZJCU01EC1KK.51.41.D08.1.454.heavy.3.raw
cgatcgtatacacgaccggtgctcgatttagtcacgcgagaaagggaaaggggctggagtgggtaggtttctttagaggcaaagcttatggtgggacaacagaatacgccgcgtctgtgataggccgattcaccatctcaagagatgattccaaaagcatcgcctatctgcacatgagcagcctgaaaaccgaggacacagccgtgtatttctgtactagagtcttcttatattactatgatactagtggttattcaggagtggggcgacggtatggacgtctggggccaagggaccacggtcaccgtctcctcagcctccaccaagggcccatcggtcttccccctggcaccctcctccaagagcacctctgggggcacagcggccctgggctgcctggtcaaggactacttcctcgtagcact

SEQ ID NO: 459315 - DNA, 492 bp, Homo sapiens
  misc_feature: HEFZJCU01B9MWF.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgacgagcacagcggccctgggctgcctggtcaaggactacttccgtatctctcg

SEQ ID NO: 459316 - DNA, 494 bp, Homo sapiens
  misc_feature: HEFZJCU01EB9C3.21.53.E09.1.454.heavy.3.raw
  modified_base (492)..(492): a, c, t, g, unknown or other
tcgtcgctcgcacgaccggtgctcgatttagagagagtgtgttgggtttggggagctctgggagaagagccccagccccagaattcccaggagtttccattcggtgatcagcactgaacacagaggactcaccatggagttttggctgagctgggttttccttgttgctattataaaaggtgtccagtgtcaggtgcagttggtggagtctgggggaggcttggtcaagcctggagggtccctgagactctcctgtgcagcctctggattcaccttcagtgactactgcatgggctggatccgccaggctccagggaagggctggagtgggtctcatatattagtagtagtggtagtcccgtatactacgcagactctgtgaagggccgattcaccatcgccagggacaacgccaagaactcacagtatctgcagatgaatagcctgagagccgaggactcggccgtgtattactgtgcgagagatcccggnga

SEQ ID NO: 459317 - DNA, 395 bp, Homo sapiens
  misc_feature: HEFZJCU01CZNHT.18.31.C09.1.454.heavy.3.raw
tacgagtatgcacgaccggtgctcgatttagacgtctcatcaaggaaggaaggggctggagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcagcctccaccaagggcccatcggtcttccccctggcaccctcctccaagagcacctctgggggcacagcggccctggctgcctggtcaaggactacttcccatactcgta

SEQ ID NO: 459318 - DNA, 511 bp, Homo sapiens; identical to SEQ ID NO: 456075
  misc_feature: HEFZJCU01EQKU8.17.33.C11.1.454.heavy.3.raw

SEQ ID NO: 459319 - DNA, 491 bp, Homo sapiens
  misc_feature: HEFZJCU01C2I93.12.75.G09.1.454.heavy.3.raw
atacgacgtacacgaccggtgctcgatttagtatagacatcaggggccctgggagcacagctcatcaccatggactggacctggaggttcctctttgtggtggcagcagctacaggtgtccagtcccaggtgcagctggtgcagtctggggctgaagtgaggaagcctgggtcctcggtgagggtctcctgcaaggcttctggaggcaccttcaacaactatgctgtcagctggatgcgacaggcccctggacaagggcttgagtggatgggaggagtcatccctctctttcgttcagcagactacgcacagaaattccaggacagagtcacgattaccgcggacgaatccacgaccacagcctacatagagctgcgcagcctgagatctgaagacacggccatttattactgtgcgagagatgcaggggccctcccacatcggttatttctttgactcctggggccagggaaccctggtcaccgtctcct

SEQ ID NO: 459320 - DNA, 525 bp, Homo sapiens
  misc_feature: HEFZJCU01BRIN1.48.2.A02.1.454.heavy.3.raw
agtatacatacacgaccggtgctcgatttagactcatctacagggggagtctccctcactgcccagctgggatctcagggcttcattttctgtcctccaccatcatggggtcaaccgccatcctcgccctcctcctggctgttctccaaggagtctgcgcggaagtgcgcctggtgcagtctggagcagtggtgaagaggcccggggagtctctaaagatctcctgtcagggttctgaaggcgactttgacaccttctgggtcgcctgggtgcgccagaggcccggtaaaggactagagtatatgggcgtcatctatcctggtgactccgataccatatatactccgtcgtttcaaggccaggtcaccatgtctgccgacaagtccaagactgtcgcctacctccactgggccaaactgacgtcctccgacagcgccacttattactgtgcgagggtaggcactacgtcttggggtcgagaggacaactggttcgacccctggggccagggaaccctggtcattg

SEQ ID NO: 459321 - DNA, 526 bp, Homo sapiens
  misc_feature: HEFZJCU01ARMCM.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactgggccagggaaccctggtcaccgtctcctcagcctcaccaa

SEQ ID NO: 459322 - DNA, 514 bp, Homo sapiens; identical to SEQ ID NO: 451806
  misc_feature: HEFZJCU01EAAR1.19.67.G01.1.454.heavy.3.raw

SEQ ID NO: 459323 - DNA, 396 bp, Homo sapiens; identical to SEQ ID NO: 444469
  misc_feature: HEFZJCU01ATZIA.47.46.E02.1.454.heavy.3.raw

SEQ ID NO: 459324 - DNA, 527 bp, Homo sapiens
  misc_feature: HEFZJCU01A52OU.9.78.H01.1.454.heavy.3.raw
tgatacgtctcacgaccggtgctcgatttagtgtgagtagtttgggtttgggtgccgaagttgctggaggtcacggtcaccacgctgctgagggagtagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggccgccctgctccaggagcacctccgagagcacagcggccctgggctgcctggtcaaggactactccacg

SEQ ID NO: 459325 - DNA, 505 bp, Homo sapiens
  misc_feature: HEFZJCU01CO50T.10.38.D05.1.454.heavy.3.raw
  modified_base (468)..(468): a, c, t, g, unknown or other
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtncgcgacatgactacgctcaattctggggccagggacg

SEQ ID NO: 459326 - DNA, 395 bp, Homo sapiens
  misc_feature: HEFZJCU01C4MNT.16.68.G02.1.454.heavy.3.raw
tgtactactccacgaccggtgctcgatttagtcgatagtgaagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaagactacttccgagtagtaca

SEQ ID NO: 459327 - DNA, 408 bp, Homo sapiens; identical to SEQ ID NO: 444522
  misc_feature: HEFZJCU01CHPAY.3.41.D08.1.454.heavy.3.raw

SEQ ID NO: 459328 - DNA, 313 bp, Homo sapiens; identical to SEQ ID NO: 444518
  misc_feature: HEFZJCU01EY9B0.7.10.A10.1.454.heavy.3.raw

SEQ ID NO: 459329 - DNA, 516 bp, Homo sapiens
  misc_feature: HEFZJCU01EHZNV.13.76.G10.1.454.heavy.3.raw
tcacgtactacacgaccggtgctcgatttagtcactcatacaggggctgggagaggagcccagcactgggattccgaggtgtttccattcggtgatcagcactgaacacagaggactcaccatggagttttggctgagctgggtttcccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtcgtggggtaccg

SEQ ID NO: 459330 - DNA, 476 bp, Homo sapiens; identical to SEQ ID NO: 452095
  misc_feature: HEFZJCU01C0L3O.16.10.A10.1.454.heavy.3.raw

SEQ ID NO: 459331 - DNA, 482 bp, Homo sapiens; identical to SEQ ID NO: 451792
  misc_feature: HEFZJCU01BH7BV.19.71.G05.1.454.heavy.3.raw

SEQ ID NO: 459332 - DNA, 508 bp, Homo sapiens
  misc_feature: HEFZJCU01BU0GC.3.17.B06.1.454.heavy.3.raw
agacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggataacaacgac

SEQ ID NO: 459333 - DNA, 489 bp, Homo sapiens
  misc_feature: HEFZJCU01CK803.51.14.B03.1.454.heavy.3.raw
cgatcgtatacacgaccggtgctcgatttagtgtgagtagtttgggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgcaaaagccaaggcaacagctggtactcaattagactactggggccagggaaccctggtcaccgtctcctcagcctccaccaagggcccatcggtcttccccctggccaccctcctccaagagcacctctgggggcacgagcggccctgggctgcctggtcaaggactacttcctcgtagcact

SEQ ID NO: 459334 - DNA, 532 bp, Homo sapiens
  misc_feature: HEFZJCU01CK53Z.3.82.H05.1.454.heavy.3.raw
agacgcactccacgaccggtgctcgatttagtcgagctctctcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctggggggtccctgagactctcctgtgcagcctctggcttcaccgtcagtagcagctacatgcactgggtccgccaggctccagggaaggggctggagtgggtctcagttatttacaattctggtaccacatactactccgaccccgtgaagggccgattaaccatctccagagacgattccgagaacacggtgtatcttcaaatgaaacaacctgagagccgacgacacggccgtttattactgtgcgagagtatcgagtggttcggggaccctcaccctggttcctacgtttcgattctctgggggccgtc

SEQ ID NO: 459335 - DNA, 506 bp, Homo sapiens
  misc_feature: HEFZJCU01DRUE1.12.33.C11.1.454.heavy.3.raw
atacgacgtacacgaccggtgctcgatttagagtgagctcgttgggtttggggggaagaggaagactgacggtccctgagactctcatgtgcagggtctggattcaactttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttcccctggccacctcctccaagagcacctctgggggcacagcggccctgggctgcctggtcaaggactacttcctacgtcgtat

SEQ ID NO: 459336 - DNA, 400 bp, Homo sapiens
  misc_feature: HEFZJCU01DRJ6O.47.24.C02.1.454.heavy.3.raw
agctcacgtacacgaccggtgctcgatttagtacagatcgttaggaaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagct

SEQ ID NO: 459337 - DNA, 517 bp, Homo sapiens
  misc_feature: HEFZJCU01EOFIT.14.14.B03.1.454.heavy.3.raw
cgtctagtaccacgaccggtgctcgatttagtgtgagtagtttgggctgagctgggtcttccttgttgctattataaaaggtgtccagtgtcaagtgcagttggtggagtctgggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcatgttttagaagttggggcttttgaccactggggccagggaaccctggtcaccgtctcttcagcctccaccaagggcccatcggtcttcccctggcaccctcctccaagagcacctctc

SEQ ID NO: 459338 - DNA, 502 bp, Homo sapiens; identical to SEQ ID NO: 453671
  misc_feature: HEFZJCU01C2RRS.26.23.C01.1.454.heavy.3.raw

SEQ ID NO: 459339 - DNA, 506 bp, Homo sapiens; identical to SEQ ID NO: 445243
  misc_feature: HEFZJCU01EOFTD.48.27.C05.1.454.heavy.3.raw

SEQ ID NO: 459340 - DNA, 530 bp, Homo sapiens
  misc_feature: HEFZJCU01BQF3B.12.86.H09.1.454.heavy.3.raw
atacgacgtacacgaccggtgctcgatttagtgctatagacttgggtttggggggaagaggaagactgacggtcctcgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactgggccagggaaccctggtgaccgtctcctcagcctccaccaagggcccatccggttcttccccctggccgccctgctccaggagcacctccgagagcacagcggccccgtggg

SEQ ID NO: 459341 - DNA, 503 bp, Homo sapiens
  misc_feature: HEFZJCU01EEE3Z.16.21.B10.1.454.heavy.3.raw
tgtactactccacgaccggtgctcgatttagtgtcgtcgcaggagagaggagcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatacctactttgactac

SEQ ID NO: 459342 - DNA, 398 bp, Homo sapiens; identical to SEQ ID NO: 444601
  misc_feature: HEFZJCU01CAUE7.4.79.H02.1.454.heavy.3.raw

SEQ ID NO: 459343 - DNA, 509 bp, Homo sapiens
  misc_feature: HEFZJCU01D5UUZ.12.78.H01.1.454.heavy.3.raw
atacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttcccctggcaccctcctccaagagcacctctggggcacagcggcccgtgggctgcctggtcaaggactacttcctacgtcgtat

SEQ ID NO: 459344 - DNA, 512 bp, Homo sapiens
  misc_feature: HEFZJCU01AQQDN.14.71.G05.1.454.heavy.3.raw
cgtctagtaccacgaccggtgctcgatttagtgtcgtcgcaagagagaggggcccagccctgggattttcaggtgttttcattcggtgatcaggactgaacagagagaactcaccatggagtttgggctgagcgtggcgttttcttagtggctattttaaaaggtgtgcagtgtgaggtgcagctgttggagtctgggggaggcttggtacagcctgggggggtccctgagactctcctgtgcagcctctggattcgtctttagcagctatgccatgagctgggctcgccaggctccagggaaggggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagatttttggagttggttattatacctttgaactcttc

SEQ ID NO: 459345 - DNA, 519 bp, Homo sapiens
  misc_feature: HEFZJCU01BP4OF.11.40.D07.1.454.heavy.3.raw
cgagagataccacgaccggtgctcgatttagtgatagagcgtaacaacagaggactcaccatggagtttgggctgacctgggtttcctcgttgctcttttaagaggtgtccagtgtcaggtgcagctggtggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgacgaaagatttctatagaggtgacgtacgggggcgttctttgactacgtggggccgagggaaccctggtcaccgtctcctcagcctccaccgaagggcccatcggtcttccccg

SEQ ID NO: 459346 - DNA, 518 bp, Homo sapiens
  misc_feature: HEFZJCU01CPXA8.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaggcccatcggtctcccctggcg

SEQ ID NO: 459347 - DNA, 516 bp, Homo sapiens
  misc_feature: HEFZJCU01CAJ52.8.33.C11.1.454.heavy.3.raw
ctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtattggacctgaacagcctaagtcctgaggacacgggtgtatactactgtacgaagggaggggggaaccaggcgggagttccaagtactcctttg

SEQ ID NO: 459348 - DNA, 430 bp, Homo sapiens
  misc_feature: HEFZJCU01DC039.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagccctacatgga

SEQ ID NO: 459349 - DNA, 517 bp, Homo sapiens
  misc_feature: HEFZJCU01CGM87.51.83.H06.1.454.heavy.3.raw
cgatcgtatacacgaccggtgctcgatttagatcacgtgcgtcgcggggcggggggaagaggaagactgacggtcctcccaggagttcaggtgcagctggtggactctgggggaggcgtggtccagcctgggaggtccctgcgactctcctgtgcagcctctggattcagcttcagggctaatactatgttctgggtgcgccaggctccaggcaaggggctggagtgggtggcagtcatctggcctgatggaggtttaacatactatgcggactccgtggagggccgattcaccgtctccagagacaactccaaaaacacgctgtatctccaaatgaacagcctcagatctgaggacacggctatctactactgtgtgaaagaattgggtttcagtggctactttgacttctggggccagggaaccctggtcaccgtctcctcagcttccaccaagggcccatcggtcttcccctggcgccctgctccaggagcacctctgggggcacagcggcctc

SEQ ID NO: 459350 - DNA, 536 bp, Homo sapiens
  misc_feature: HEFZJCU01DZP94.19.26.C04.1.454.heavy.3.raw
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtcgtggggccaagggaccacggtcatcgtcctccccacgcctccaccgaaaggggccccagtccggtcctttcccccgtcggccgccctgcctcccagggacgcctacccg

SEQ ID NO: 459351 - DNA, 505 bp, Homo sapiens; identical to SEQ ID NO: 458486
  misc_feature: HEFZJCU01DXDNE.17.25.C03.1.454.heavy.3.raw

SEQ ID NO: 459352 - DNA, 489 bp, Homo sapiens
  misc_feature: HEFZJCU01DKXKL.3.48.E04.1.454.heavy.3.raw
agacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggaggcgtggcccagcctgggaggtccctcagactctcctgtgcagcgtctggattcagtttcgctacacatggcatgcactgggtccgccagtctccaggcaaggggctgcagtgggtggcgtttattcgaagcgatgggactcatgaacaatatgcagactccgtgaagggccgattcatcatctccagagacaactccaacaacacactggatctccaaatgaacagcctgagagtcgaggacacggccgtatattattgtgcccttgactttacta

SEQ ID NO: 459353 - DNA, 436 bp, Homo sapiens; identical to SEQ ID NO: 447936
  misc_feature: HEFZJCU01DV8S7.3.21.B10.1.454.heavy.3.raw

SEQ ID NO: 459354 - DNA, 421 bp, Homo sapiens
  misc_feature: HEFZJCU01C4Y0D.51.41.D08.1.454.heavy.3.raw
cgatcgtatacacgaccggtgctcgatttagtcacgcgagaaagggaaggggctggagtgggtaggtttctttagaggcaaagcttatggtgggacaacagaatacgccgcgtctgtgataggccgattcaccatctcaagagatgattccaaaagcatcgcctatctgcacatgagcagcctgaaaaccgaggacacagccgtgtatttctgtactagagtcttcttatattactatgatactagtggttattcaggagtggggcacggtatggacgtctggggccaagggaccacggtcaccgtctcctcagcctccaccaaggcccatcggtcttcccctggcaccctcctccaagagcacctctgggggcacagcggccctgggctgcctggtcaaggactacttcctcgtagcact

SEQ ID NO: 459355 - DNA, 529 bp, Homo sapiens
  misc_feature: HEFZJCU01DKKMH.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttccccctggcgccctgctccaggagcacctccgagacgcacagccggccctgggcc

SEQ ID NO: 459356 - DNA, 495 bp, Homo sapiens
  misc_feature: HEFZJCU01C5IJX.49.48.E04.1.454.heavy.3.raw
  modified_base (441)..(441): a, c, t, g, unknown or other
agtcgagagacacgaccggtgctcgatttagagagcgtcacagagagaagggggcatcatccaacaaccacatcccttctctacagaagcctctgagagggaagttcttcaccatggactggacctggagggtcttctgcttgctggctgtagctccgggtgctcactcccaggtgcagttggtgcagtctggggctgaggtgaagaagtctggggcctcagtgaagatttcctgcaaggcttctggataccccttcaccatctaccacatgcactgggtgcgacaggccccgggacaagggcttgagtggatgggaataatcaacctagtggtggtagcacaacctccgcacagaggttccagggcagagtcaccatgaccagggaccacgtccacgagcacattctacatggaactgagccgcctgagatctgaccganacggccgtgtactactgtgcgagagtcactcatttactacgatagttatgggtg

SEQ ID NO: 459357 - DNA, 491 bp, Homo sapiens; identical to SEQ ID NO: 446104
  misc_feature: HEFZJCU01BWFPZ.3.34.D01.1.454.heavy.3.raw

SEQ ID NO: 459358 - DNA, 502 bp, Homo sapiens
  misc_feature: HEFZJCU01B4UUL.53.30.C08.1.454.heavy.3.raw
  modified_base (485)..(485): a, c, t, g, unknown or other
cgcgtatacacacgaccggtgctcgatttagtctgacgtcaaagggaaaggggggtgatcatcactgaacacagaggactcaccatggagtttgggctgagctgggttttcctcgttgctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcacttatatcctatgatggaagcaataagcactacgcagagtccgtgaagggccgattgaccatctccagagacaactcgaagaatacggttcttctacaaatgaacagcctgagagctgaggacacggctatcttttactgtgcgagagggaactcgattacagcagccctcgaagaacatcatgatggctttgattntctgggggccaagggac

SEQ ID NO: 459359 - DNA, 463 bp, Homo sapiens
  misc_feature: HEFZJCU01BPPQA.19.10.A10.1.454.heavy.3.raw
tactctcgtgcacgaccggtgctcgatttagcgtcgatctcaggggtccctgagactctcctgtagaagttatggattcaacttcgctagcggctggctgtgctgggttcgccaggctccagggaaggggctggagtgggttggccgcatcaagaggagatatgaaggggaggcgacagactacgctgcacccgtgagaggcagatttaccatgtcaagagatgattcacaaagtacagtgtatctgcaaatgaacagcctgaagaccgaggacacagccatttactattgtacaaatgaatactgggacggggggaaaattggggccagggaaccctggtctccgtctcgtcagcctccaccaagggcccatcggtcttcccctggcgccctgctccaggagcacctccgagagcacagcggccctgggctgcctggtcaaggactacttcccacgagagta

SEQ ID NO: 459360 - DNA, 528 bp, Homo sapiens
  misc_feature: HEFZJCU01CGO6X.16.86.H09.1.454.heavy.3.raw
tgtactactccacgaccggtgctcgatttagtgctatagactgggttttgggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaagggcctggagtggattgggaacatctattacagcgggagcaccaactacaacccgtccctcaagagtcgagttaccatttcattaaacacgtctaagaaccagttctccctgaacgctgacctttgtgactgccgcggacacggccgtgtattactgtgcgagagacccctccgatagcagtggctggtccactaggtttgactactggggccagggaagcttggtcaccggtctccctcagcctccc

SEQ ID NO: 459361 - DNA, 462 bp, Homo sapiens; identical to SEQ ID NO: 454446
  misc_feature: HEFZJCU01ANQCX.19.10.A10.1.454.heavy.3.raw

SEQ ID NO: 459362 - DNA, 525 bp, Homo sapiens
  misc_feature: HEFZJCU01CHYSR.48.4.A04.1.454.heavy.3.raw
agtatacatacacgaccggtgctcgatttagagtagtgatcagggggtgctttctgagagtcatggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctgaaactgaccgctgtgaccgccgcggacacggctgtgtattactgtgcgagacgaatgggcgggtggctacgacttgacttttggggccagggaaacctggtcaccgtctccccagccttccaccaaggcccatcggtcttccccg

SEQ ID NO: 459363 - DNA, 497 bp, Homo sapiens
  misc_feature: HEFZJCU01E0DQR.3.35.D02.1.454.heavy.3.raw
agacgcactccacgaccggtgctcgatttagcacacgatagttgggtttgggggaggcttggtgcagcctggggggtctctgagactctcctgtgcagcctctggagtgacctttagcaaatatggcatggcctgggtccgtcaggttccagggaaggggctggagtgggtctcggctattagtggccgtggtgaaagcatcttctacgcagactccgtgaagggccgattcaccatctccagagacaattccagggacacgctgtatctgcagatggacagcctgagagtcgaggacacggccttatattactgtgcgaaagccgtagtggcaacaacgttgtgctttgactcctggggccagggaaccctggtcgccgtctcctcagcctccaccaagggcccatcggtcctcccctggcaccctcctccaagagcacctctgggggcacagcggccctgggctgcctggtcaaggactacttccgagtgcgtct

SEQ ID NO: 459364 - DNA, 484 bp, Homo sapiens; identical to SEQ ID NO: 452752
  misc_feature: HEFZJCU01B15E6.11.23.C01.1.454.heavy.3.raw

SEQ ID NO: 459365 - DNA, 508 bp, Homo sapiens
  misc_feature: HEFZJCU01DBVFH.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgacgcctacggcagccggtcctttgactttcgtc

SEQ ID NO: 459366 - DNA, 512 bp, Homo sapiens
  misc_feature: HEFZJCU01AE7R8.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctgggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaatgaacagcctgagagccgacgacacggccatatattactgtgcgaaagcaccggcagttagtcacccatactactttgactactggggccaac

SEQ ID NO: 459367 - DNA, 509 bp, Homo sapiens; identical to SEQ ID NO: 445824
  misc_feature: HEFZJCU01B4YXS.9.14.B03.1.454.heavy.3.raw

SEQ ID NO: 459368 - DNA, 491 bp, Homo sapiens
  misc_feature: HEFZJCU01BOR77.11.71.G05.1.454.heavy.3.raw
cgagagataccacgaccggtgctcgatttagtgtcgtcgcaagagagagggggagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgcgaagatttctat

SEQ ID NO: 459369 - DNA, 498 bp, Homo sapiens
  misc_feature: HEFZJCU01EYR2D.14.25.C03.1.454.heavy.3.raw
  modified_base (471)..(471): a, c, t, g, unknown or other
cgtctagtaccacgaccggtgctcgatttagtagtgtagatttgggtttggggagacgagcccagcactggaagtcgccggtgtttccattcggtgatcagcactgaacacagaggactcaccatggagtttgggctgagcgtgggttttccgtcgttaggctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtatttacngtgggagagatggaggtcgattattgt

SEQ ID NO: 459370 - DNA, 511 bp, Homo sapiens
  misc_feature: HEFZJCU01CXOHE.22.86.H09.1.454.heavy.3.raw
acatacgcgtcacgaccggtgctcgatttagtgctatagacttgggtttgggctgagcgtgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagctttgatctctggggccaagggacactggtcaccgtctcttcagccctccaccaagggcccatcggtccttccccctggccgccctgctccaggacg

SEQ ID NO: 459371 - DNA, 509 bp, Homo sapiens
  misc_feature: HEFZJCU01CO73C.3.55.E11.1.454.heavy.3.raw
agacgcactccacgaccggtgctcgatttagcactcgcacgttgggtttgggattcacgttgcagatgtaggtccctgagactctcctgtgcagcctctggattcaccttcagtagatatgctatgtattgggtccgtcaggctccaggcaaggggctggagtgggtggcagttatgtcacatgatggaagaaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaatgactacggtggtaaccttccagactactggggccagggaaccctggtcaccgtctcctcagcctccaccaagggcccatcggtcttccccctggccaccctcctccaagagcacctctgggggcacagcggccctggctgcctggtcaaggactacttccgagtgcgtct

SEQ ID NO: 459372 - DNA, 530 bp, Homo sapiens
  misc_feature: HEFZJCU01B5EIV.12.33.C11.1.454.heavy.3.raw
atacgacgtacacgaccggtgctcgatttagagtgagctcgttgggtttggggggaagaggaagactgacggtccccccaggagttcaggtgctgggcacggtgggcatgtgtgagttttgtcacaagatttgggctcaactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaacgggcccatcggtccttccccctcggccaccctccctccaacgagccacctctcggggggcacc

SEQ ID NO: 459373 - DNA, 510 bp, Homo sapiens; identical to SEQ ID NO: 448445
  misc_feature: HEFZJCU01EMB2O.16.71.G05.1.454.heavy.3.raw

SEQ ID NO: 459374 - DNA, 525 bp, Homo sapiens
  misc_feature: HEFZJCU01C7BR3.12.86.H09.1.454.heavy.3.raw
atacgacgtacacgaccggtgctcgatttagtgctatagacttgggtttggggggaagaggaagactgacggtcctgcaacaggtgcccactccccggttcaagtgttgcagtctggacctgaggtgaagacgcctggggcctcagtgaaggtctcctgcaaggcttccggttactccttccccgcctacggtgtcacctgggtgcgacaggcccctggacaaggacttgagtggatgggatggatcagccctaacaatggtaacacagaatatccacagaagttccagggcagagtcaccatgaccacagaaacatccatgaccacagtctatatggacctgaggagcctcagatctgacgacacggccgtgtatttctgtgcgagtcttgatagtagtggttatcctgaatactggggccagggaaccctggtgaccgtctcctcagcctccaccaagggcccatcggtcttcccctggcaccctgctccaggagcacctccgagagcacagcggccctgggc

SEQ ID NO: 459375 - DNA, 384 bp, Homo sapiens; identical to SEQ ID NO: 444454
  misc_feature: HEFZJCU01CSGA5.11.61.F06.1.454.heavy.3.raw

SEQ ID NO: 459376 - DNA, 514 bp, Homo sapiens
  misc_feature: HEFZJCU01CFP2G.3.34.D01.1.454.heavy.3.raw
agacgcactccacgaccggtgctcgatttagatcgtctgtgttgggtttgggggagacctggttgagcctggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctgggggccaagggaccacggtcatcgtctccgcagcctccaccaacgggcccatcggtcttcccctggcaccctcctccaagagcacctctgggggcacagcggccctgggctgcctggtcaaggactacttccgagtgcgtct

SEQ ID NO: 459377 - DNA, 510 bp, Homo sapiens
  misc_feature: HEFZJCU01EAD58.40.10.A10.1.454.heavy.3.raw
tctagcgactcacgaccggtgctcgatttagcgtcgatctcaggggggtctcagagaggagccttagccctggactccaaggcctttccacttggtgatcagcactgagcacagaggactcaccatggaattggggctgagctgggttttccttgttgctattttagaaggtgtccagtgtgaggagcagctggtggagtctgggggaggcttggtccagcctggggggtccctgagactctcctgtgttgcctctgggttcacatttcgtaacaattggatgacctgggtccgccaggctccagggaaggggctggagtgggtggccaatataaaccgagatggaaataagatatactatgtggactctgttaagggccgattcaccatctccagagacaacgccaagagttcactgtttctgcaaatgagcagcctgagagccgaggacacggctctatattactgtacgagagatttcagcccctcccaaagtgggaaaattattaa

SEQ ID NO: 459378 - DNA, 491 bp, Homo sapiens
  misc_feature: HEFZJCU01A9PBM.19.53.E09.1.454.heavy.3.raw
tactctcgtgcacgaccggtgctcgatttagagagagtgtgttgggtttggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtccaccgtctcctcagcctccaccaagggcccatcggtcttcccctggcgccctgctccaggagcacctccgagagcacagcggccctgggctgcctggtcaaggactacttcccacgagagta

SEQ ID NO: 459379 - DNA, 508 bp, Homo sapiens
  misc_feature: HEFZJCU01DTZV1.3.17.B06.1.454.heavy.3.raw
agacgcactccacgaccggtgctcgatttagtcgatagtgaaggggagctctgagagcggagccccagccccagaattcccaggtgttttcatttggtgatccagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgac

SEQ ID NO: 459380 - DNA, 467 bp, Homo sapiens
  misc_feature: HEFZJCU01BPXNO.48.59.F04.1.454.heavy.3.raw
agtatacatacacgaccggtgctcgatttagtacacacacttagggattgggtagggattggggcagggtgtacacctgtggttctcggggctgccctttggctttggagatggttttctcgatgggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttcccctggccaccctcctccaagagcacctctgggggcacagcggccctgggctgcctggtcaaggactacttcctatgtatact

SEQ ID NO: 459381 - DNA, 526 bp, Homo sapiens
  misc_feature: HEFZJCU01DGTA0.48.65.F10.1.454.heavy.3.raw
agtatacatacacgaccggtgctcgatttagctacgctctaagggggctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttctatggtgggtccttcagtggttactactggagctggatccgccagcccccagggaaggggctggagtggattggggaaatcaatcatagtggaagcaccaactacaacccgtccctcaggagtcgagtcaccatatcagtagacacgtccaagaaccagttctccctgaagctgagctctgtgaccgccgcggacacggctgtgtattactgtgcgagagcgggatattgtagtagtaccagctgctatttttgtccggttggttcgacccctggggccaggggaaccctggtcaccgtctcctcagcctccaccg

SEQ ID NO: 459382 - DNA, 478 bp, Homo sapiens; identical to SEQ ID NO: 449662
  misc_feature: HEFZJCU01DBUHL.12.81.H04.1.454.heavy.3.raw

SEQ ID NO: 459383 - DNA, 495 bp, Homo sapiens; identical to SEQ ID NO: 445359
  misc_feature: HEFZJCU01EGX97.4.21.B10.1.454.heavy.3.raw

SEQ ID NO: 459384 - DNA, 477 bp, Homo sapiens
  misc_feature: HEFZJCU01EB10O.4.37.D04.1.454.heavy.3.raw
agcactgtagcacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccgcctactatatgcactgggtgcgactggcccctggacaagggcttgagtggatgggatggatcgaccctaacagcggtggcacaaagtatgcacagaagtttcagggcagggtcaccatgaccagggacacgtccatcagcacgtccatcagcacagcctacatggacctgagcggcctgacatctgacgacacggccgtatattctgtgcgagg

SEQ ID NO: 459385 - DNA, 510 bp, Homo sapiens
  misc_feature: HEFZJCU01CLLSL.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaactatgtggactctgtgaacggccgattcaccatctccagagacaacgccaagaattcactgtatttgcaatgaacagcctgagaggcgaggacacggccgtgtattattgtgcgcgagatgatagtagactctacagtagcaggtggta

SEQ ID NO: 459386 - DNA, 491 bp, Homo sapiens; identical to SEQ ID NO: 446104
  misc_feature: HEFZJCU01EX7WC.3.34.D01.1.454.heavy.3.raw

SEQ ID NO: 459387 - DNA, 531 bp, Homo sapiens; identical to SEQ ID NO: 458407
  misc_feature: HEFZJCU01B4RO6.7.78.H01.1.454.heavy.3.raw

SEQ ID NO: 459388 - DNA, 533 bp, Homo sapiens
  misc_feature: HEFZJCU01CD76W.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagttttaattattggtggggctggatccgccagcccccagggaaggggctggaatggattgggagtatattttataatggggacactctttacaacccatccctcaagagtcgagtttccatatccgcagacacgtccgagaatcacttctccctgaaactgagctctgtgaccgccgcagacacggctgtttatttactgtttcgagacatgccgaccgagagcattatcggcagtacggttttgtatattttgggggcctaagggacaaaggggtcaccggtctccgccagccctccaacccg

SEQ ID NO: 459389 - DNA, 494 bp, Homo sapiens
  misc_feature: HEFZJCU01BG3AV.10.71.G05.1.454.heavy.3.raw
catagtagtgcacgaccggtgctcgatttagtgtcgtcgcaagagagaggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggtgtttattactgtgggagaaatcctagtggc

SEQ ID NO: 459390 - DNA, 481 bp, Homo sapiens
  misc_feature: HEFZJCU01BYMGF.7.10.A10.1.454.heavy.3.raw
cgtgtctctacacgaccggtgctcgatttagcgtcgatctcaggggtccctgagactctcctgtgacgcctctggcttcccctttagtgactactacatgagctggatccgccagggtccagggaaggggctggagtggattgcatatattagtaatagtggtagtagtagagaccacgcagactctgtgaagggccgattcaccatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggactacttcctagagaacg

SEQ ID NO: 459391 - DNA, 518 bp, Homo sapiens
  misc_feature: HEFZJCU01CJ5RN.9.14.B03.1.454.heavy.3.raw
tgatacgtctcacgaccggtgctcgatttagtgtgagtagtttgggtctgggggaggcttggtcaagcctggagggtccctgagactctcctgtgcagcctctggattcgcctctggattgacgttcagtgactactacatgacctgggtccgccaggctccagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccgatcggtcttccccctcggccgccctcgctccaggagcacctccgagagcacagcggcccgtcgggcgtgcctggtcaaggactacttaccagacgtatca

SEQ ID NO: 459392 - DNA, 522 bp, Homo sapiens
  misc_feature: HEFZJCU01A961K.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatctattgttgttttcgattgcctttcggtccggcgggtactttcgtggggccagggtaaccccg

SEQ ID NO: 459393 - DNA, 522 bp, Homo sapiens
  misc_feature: HEFZJCU01EWWZJ.19.86.H09.1.454.heavy.3.raw
tactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttcccctggcgccctgctccagagcacctccgagagcacagcggccctgggtcg

SEQ ID NO: 459394 - DNA, 487 bp, Homo sapiens
  misc_feature: HEFZJCU01EAXZS.51.1.A01.1.454.heavy.3.raw
cgatcgtatacacgaccggtgctcgatttagacgtctcatcaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagggtctatgacatgcactgggtccgccaggctccaggcaaggggctggagtgggtggcagttatatcatatgatggaagtaatatatactatgtagactccgtgaagggccgattcatcatctccagagacaattccgagaacacgctgtatctgcaaatgaacagcctgagagttgaggacacggctgtgtattattgtgcgaacttaatcacggaggacaac

SEQ ID NO: 459395 - DNA, 513 bp, Homo sapiens
  misc_feature: HEFZJCU01DMATY.12.73.G07.1.454.heavy.3.raw
atacgacgtacacgaccggtgctcgatttagctctacgctcagggggagaaaggagccttagccctggattccaaggcctatccacttggtgagcagcactgagcaccgagaattcaccatggaactggggctccgctgggtcttccttgttgctattttagaaggtgtccagtgtgaagtgctgttggtggagtctgggggaggcctggtcaagcctgggggatccctgagactctcctgtgcagcctctggattcagcttcagtcactatagtatgaactgggtccgccagactcctgggaaggggctggagtgggtctcattcatcagtagtgccaacaattacatttactacgccgactcagtgaagggccggttcaccatctccagagacaacgccaatgactcactgaatctgcaactgaaaagcctgagagccgaggacacgggcaatttatttctgtgcgagaagttttagaggaacgcagataagagggggggcagtggacgtc

SEQ ID NO: 459396 - DNA, 531 bp, Homo sapiens; identical to SEQ ID NO: 445817
  misc_feature: HEFZJCU01BYPSS.7.78.H01.1.454.heavy.3.raw

SEQ ID NO: 459397 - DNA, 501 bp, Homo sapiens
  misc_feature: HEFZJCU01CXQL6.10.23.C01.1.454.heavy.3.raw
catagtagtgcacgaccggtgctcgatttagtacacgtgattagggattggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctggggaggcttggtacagcctggcaggtccctgagactctcctgtgcagcctctggattcagctttgatgaatatgccatggactgggtccggcaagttccagggaaggcctggagtgggtctcaggtattgattggaatagtggtaccattgcctatgcggactctgtgaagggccgattcaccatcaccagagacgacgccaggagctccctgtatctccaaatgaacagtctgagacctgaggacacggccttgtattactgtgtaagagggatcgagggtttctaaa

SEQ ID NO: 459398 - DNA, 499 bp, Homo sapiens
  misc_feature: HEFZJCU01A5P4I.16.34.D01.1.454.heavy.3.raw
tgtactactccacgaccggtgctcgatttagatcgtctgtgttgggtttgggggaggcttggtacagcctggggggtccctgagactctcctgtgcagcctctggattcatctttagcaactatggcatgacctgggtccgccaggctccagggaagggtctggagtgggtctcaggaatcagtggtggtggtggtagaacaaactacgcagactccgtgaagggccggttcatcatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaagggcccatcggtcttcccctcggcaccctcctccaagagcacctctgggggcacacgcggccctgggcgtgcctggtcaaggactacttcgagtagtaca

SEQ ID NO: 459399 - DNA, 504 bp, Homo sapiens
  misc_feature: HEFZJCU01C9UQK.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgactccggtgagcctacggcagcggcctttgacttctc

SEQ ID NO: 459400 - DNA, 506 bp, Homo sapiens
  misc_feature: HEFZJCU01C5MIH.48.83.H06.1.454.heavy.3.raw
agtatacatacacgaccggtgctcgatttagatcacgtgcgtcgcgggggcatcacatagcaaccacgttcctcctctaaagaagccccggggagcacagcccatcaccatggactggacctggaggttcctctttgtggtggcagcagctacaggtgtccggtctcaggtacagctggtgcaatctggggctgaggtgcggaagcctgggtcctcggtgagggtctcctgcaaggctcctggaggcagtttcagcatcgacgccgtcagttgggtgcgacaggcccctggacacgggcttgagtggatgggatcgatcatccctttctctaatgtcacaagatacacacagagattccagggcagaatcacacttaccgcggacaaatccacgggcacagcgcagttggacctgagcggcctgagacctgaggacacggccatttactactgtgcgcggggaggtggacggagctcggttttcggagttagtcatctactacttt

SEQ ID NO: 459401 - DNA, 505 bp, Homo sapiens
  misc_feature: HEFZJCU01CBYS7.16.37.D04.1.454.heavy.3.raw
tgtactactccacgaccggtgctcgatttagtagcatactgtgggtttgggggagacttagtacagccgggggggtccctgagactctcctgtgcagcctctggattcacctttagtgcctatgccatgagctgggtccgccaggctccagggaaggggctagaatgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccacctcagtcagctggttcgacccctggggccagggaaccctggtcaccgtctcctcagcctccaccaagggcccatcggtcttccccctggcaccctcctccaagagcacctctgggggcacagcggccctgggctgcctggtcaggactacttccgagtagtaca

SEQ ID NO: 459402 - DNA, 521 bp, Homo sapiens
  misc_feature: HEFZJCU01BOZYM.48.38.D05.1.454.heavy.3.raw
agtatacatacacgaccggtgctcgatttagtatctgatagttgggtttgggctgaactgggttttcctcgttgctcttttaagagatgtccagtgtcgggtgcagttggtggagtcggggggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaggcccatcggtcttcccctcggcgccctgctccaggagcacc

SEQ ID NO: 459403 - DNA, 522 bp, Homo sapiens; identical to SEQ ID NO: 449550
  misc_feature: HEFZJCU01CHIRW.12.40.D07.1.454.heavy.3.raw

SEQ ID NO: 459404 - DNA, 515 bp, Homo sapiens
  misc_feature: HEFZJCU01EJEAV.16.21.B10.1.454.heavy.3.raw
  modified_base (471)..(471): a, c, t, g, unknown or other
tgtactactccacgaccggtgctcgatttagtgtcgtcgcaggagagaggagcccagccctgggattttcaggtgttttcatttggtgatcaggactgaacagagagaactcaccatggagtctgggctgagctggcttttcttgtggctattttaaaaggtgtccagtgtgaggtgcagctgttggagtctgggggaggcttggcacagcctggggggtccctgagactctcctgtgcagcctctggattcacccttagcggttatgccatgagctgggtccgccaggctccgagggaaggggctggagtgggtctcaacttttagtggtagtggtggtcacgcctactacgcagagtccgtgaagggccgattccaccatcctccagagacacttccgagaacacgctgtatctgcgaatgaacagcctgagagtcgaggacacggccatatattactgtgcgaaaagntcctgacggcctatacccacctcagtccagctggttccgacccc

SEQ ID NO: 459405 - DNA, 539 bp, Homo sapiens
  misc_feature: HEFZJCU01BI62C.13.76.G10.1.454.heavy.3.raw
tcacgtactacacgaccggtgctcgatttagtcactcatacagggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccagccgggggggtccctgagactctcatgtgcggcctctgggctcaccgtcaacaccaactacatgagctgggtccgccaggctccagggaagaggccggagtgggtctcagttatttatgtcgacggtgccacattctacgcagactccgtgaggggccggttcaccatcctccagagacaattccaagaacacggtgtatcttcaaatgaacgacctgagagtcgaggacacggccgtctattactgtgcgaaagatgcagagagggccccgtaatggggcctggtggagggttcttctttgactgctggggccagggtaacccg

SEQ ID NO: 459406 - DNA, 508 bp, Homo sapiens
  misc_feature: HEFZJCU01AR53D.14.78.H01.1.454.heavy.3.raw
cgtctagtaccacgaccggtgctcgatttagtgtgagtagtttgggtttggggggaggcttggtcaagcctggagggtccctgagactctcctgtgcagcctctggattcaccttcagtgactactacatgacctggatccgccaggcgccagggaaggggctggaatggattgcatacattcactatagtggaaatgcagtgtcctacgcagactctctgaagggccgattcaccgtctccagggacaacgccaagaactcgctgtatctgcaaatcgacggcctgagagtcgaggacacggccatgtattactgtgcgagagtgtggttcggtcatgtttagaagttggggcttttgaccactgggccagggaaccctggtcaccgtctccttcagcctccaccaagggcccatcggtccttcccctggccaccctcctccaagagcacctctgggggcacagcggccctgggctgcctggtcaaggactacttccgtactagacg

SEQ ID NO: 459407 - DNA, 499 bp, Homo sapiens; identical to SEQ ID NO: 447792
  misc_feature: HEFZJCU01EKOPF.17.10.A10.1.454.heavy.3.raw

SEQ ID NO: 459408 - DNA, 524 bp, Homo sapiens; identical to SEQ ID NO: 445889
  misc_feature: HEFZJCU01EBFKF.18.33.C11.1.454.heavy.3.raw

SEQ ID NO: 459409 - DNA, 499 bp, Homo sapiens
  misc_feature: HEFZJCU01BNTMR.48.34.D01.1.454.heavy.3.raw
agtatacatacacgaccggtgctcgatttagatcgtctgtgttggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgcctgctccaggagcacctccgagagcacagcggccctgggctgcctggtcaaggactacttcctatgtatact

SEQ ID NO: 459410 - DNA, 316 bp, Homo sapiens
  misc_feature: HEFZJCU01DRB2Z.47.84.H07.1.454.heavy.3.raw
agctcacgtacacgaccggtgctcgatttagcagacgtctgtcgcggggccgattcaccgtctccagagacaattccaagaacacgctatatttgcaaatgaacagcctgagacctgaggacacggctgtgtattactgtacgagaccttatggcggggactactttgactactggggccagggaaccctggtcaccgtctcctcagcctccaccaagggcccatcggtcttccccctggcaccctcctccaagagcacctctggggcacagcggccctgggctgcctggtcaaggactacttcctacgtgagcct

SEQ ID NO: 459411 - DNA, 482 bp, Homo sapiens; identical to SEQ ID NO: 444503
  misc_feature: HEFZJCU01BZQLG.7.10.A10.1.454.heavy.3.raw

SEQ ID NO: 459412 - DNA, 482 bp, Homo sapiens; identical to SEQ ID NO: 451792
  misc_feature: HEFZJCU01EO8G7.19.71.G05.1.454.heavy.3.raw

SEQ ID NO: 459413 - DNA, 500 bp, Homo sapiens
  misc_feature: HEFZJCU01C8C6K.4.21.B10.1.454.heavy.3.raw
agcactgtagcacgaccggtgctcgatttagtgtcgtcgcaagagagggggggtcccttagactctcctgtgcagtctctggactcaacctcaaaaatgcctggatgacctgggtccgccagactccagggaaggggctgcagtgggttggccgtattataaccaaacctgatggtgagacaacagactacgctgcacccgtgaaaggcagattcaccatctcaagagatgattcaacgaacacgctgtttttggaaatgaacagcctgaaaaccgaggacacagccgtttatttctgttccacactccctgcctacagagatttcgtggactataatcgccatatggacgtctggggccaagggaccacagtcaccgtctcctcaacctccaccaagggcccatcggtcttcccctggcgccctgctccaggagcacctccgagagcacagcggccctcgggctcgcctggtcaaggactaacttccctactagtcgct

SEQ ID NO: 459414 - DNA, 499 bp, Homo sapiens; identical to SEQ ID NO: 453198
  misc_feature: HEFZJCU01ES9HK.11.71.G05.1.454.heavy.3.raw

SEQ ID NO: 459415 - DNA, 512 bp, Homo sapiens
  misc_feature: HEFZJCU01E0IZF.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagcctgagaggcgaggacacggcagtgtattactgtgcgagagatcgacatgactacgggaaagcttttgatctctggggccaagggacactggtcaccgtctcttcagcctccaccaacgggcccatccggtcttccccctggccgccctgcctccaggacg

SEQ ID NO: 459416 - DNA, 514 bp, Homo sapiens
  misc_feature: HEFZJCU01AE4PQ.52.28.C06.1.454.heavy.3.raw
cgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaagggcttgagtggatggggtggaacaatcccaacagtggaggcaccggtcgcacagaatatgcgcggaagtttcagggcagggtcaccatgaccagcgacaggtccactaacacagcctacatggagctaagtagactgacatctgacgacacggccgtctattattgtgtgagagaggacccgatgacctcgaacatggacgtcgtggggccg

SEQ ID NO: 459417 - DNA, 532 bp, Homo sapiens
  misc_feature: HEFZJCU01BRDDZ.19.48.E04.1.454.heavy.3.raw
tactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgccaggctccggggaaggggccggagtgggtggccaacataatgcaagatggaactgagaaaaactatggggactctgtgaagggccgattcaccatctccagagacaaccgtaagaacttactgtttctgcaaatgaacagcctgagagccgaggacacggctgtgtattattgtgcgaagggcagtggctgggacatggacgtctggggccaaggggaccacggtcaccgt

SEQ ID NO: 459418 - DNA, 497 bp, Homo sapiens
  misc_feature: HEFZJCU01CBPT3.40.37.D04.1.454.heavy.3.raw
tctagcgactcacgaccggtgctcgatttagtagcatactgttgggtttgggggaggcttggtacagcctggggggtccctgagactctcctgtgcagcctctggattcacctttagcaactatgccatgacctgggtccgccagactccagggacggggctggagtgggtttcatctattggtggtggtggcattgacacacactacgccgactccgtgaagggccggttcaccatctccagagacaattccaggaacacactgtatctgcaaatgaacggcctgacagccgaggacacggccaaatattactgtgtgaaggatcaggaagtgggagctggtaggcctcaatactggggccggggaatcctggtcaccgtctcctcagcctccaccaagggcccatcggtcttccccctggcgccctgctccaggagcacctccgagagcacagcggccctgggctgcctggtcaaggactactccagtcgctaga

SEQ ID NO: 459419 - DNA, 482 bp, Homo sapiens; identical to SEQ ID NO: 444503
  misc_feature: HEFZJCU01BUPBG.7.10.A10.1.454.heavy.3.raw

SEQ ID NO: 459420 - DNA, 533 bp, Homo sapiens
  misc_feature: HEFZJCU01D1OEF.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttggttctggggccaggggaccctggtcatcgtctccccacgcctccaccaacgggcccatcggtccttcccctggccgcccgtcg

SEQ ID NO: 459421 - DNA, 510 bp, Homo sapiens
  misc_feature: HEFZJCU01BYSN6.22.86.H09.1.454.heavy.3.raw
acatacgcgtcacgaccggtgctcgatttagtgctatagacttgggtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctccagagacaactccaagaacactctgtttctccaaatgaacagtctgagaggcgaggacacggcagtgtattactgtgcgagagatcgacatgactacgggaaagcttttgatctctggggccaagggacactggtcaccgtctcttcagcctccaccaagggcccagtcggtcttccccctggccgccctgctccaggacg

SEQ ID NO: 459422 - DNA, 511 bp, Homo sapiens
  misc_feature: HEFZJCU01EXSVS.10.85.H08.1.454.heavy.3.raw
catagtagtgcacgaccggtgctcgatttagtatcactcagtcgcgggtgaccgtgacctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccctgagactctcctgtggagcgtccggattcgactttgatacttattggatgagctgggtccgccaggctccagggaaggggctggagtgggtggccaccataaaggaagatggaagtgagaactacttgtggctctgtgaagggccgattcacatctcagagacaacgccaagaagtcactgatctgcaaatgaaacgatgtgagagtcga

SEQ ID NO: 459423 - DNA, 503 bp, Homo sapiens
  misc_feature: HEFZJCU01D9S6P.15.55.E11.1.454.heavy.3.raw
tctacgtagccacgaccggtgctcgatttagcactcgcacgttgggtttgggggaggcttggtacagcctggggggtccctgagactctcctgtgcagcctcaggattcgcctttcgcatctatgccatgacctgggtccgccaggctccagggaaggggctggagtggatctcagctattagtggaggtgttagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggagcccgttgactactggggccagggaaccctggtcaccgtctcctcaacctccaccaagggcccatcggtcttcccctggcaccctcctccaagagcacctctgggggcacagcggccctgggctgcctggtcaaggactacttccgctacgtaga

SEQ ID NO: 459424 - DNA, 498 bp, Homo sapiens
  misc_feature: HEFZJCU01DGIRS.53.1.A01.1.454.heavy.3.raw
cgcgtatacacacgaccggtgctcgatttagacgtctcatcagggggagcatcacataacaaccagattcctcctctaaagaagcccctgggagcacagctcatcaccatggactggacctggaggttcctctttgtggtggcagcagctaccggtgtccagtcccaggtccacctggtgcaatccgggactgaggtgaagaagcctgggtcctcggtgaaggtctcctgcaaggcctctggagacaccttcaacagttatggtatcagttgggtgcgacaggcccctggacaagggcttgagtggatgggaaggatcatcccaatccttggtattacaaaaatgcacagaggtttcagggcagagtcctgttaaccgcggacaaatccactaccacagtctacatggagctgagcagcctgagatctgaagacacggccctgtactattgtgcgagagaaatgtacttctatgacagtactaatcaatatgcttttg

SEQ ID NO: 459425 - DNA, 379 bp, Homo sapiens; identical to SEQ ID NO: 444450
  misc_feature: HEFZJCU01AWDCV.47.77.G11.1.454.heavy.3.raw

SEQ ID NO: 459426 - DNA, 522 bp, Homo sapiens
  misc_feature: HEFZJCU01CAUVM.9.33.C11.1.454.heavy.3.raw
tgatacgtctcacgaccggtgctcgatttagagtgagctcgttgggtttgggctgagctgggttttcctcgttgctcttttaagaggtgtccagtgtcaagtgcaactggtggagtctggggggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagagacaattccaagaacacgatgtatctgcaaatggacagcctaagagttgaggacacggctgtttattactgtacgaaagaggggggatacagtggcagctccaagtactactttgactttctggggccagggaaccctggtcaccgtctcctcagcctccaccaagggcccatcggtctcccctggcgcctgctccaggagcacctccg

SEQ ID NO: 459427 - DNA, 499 bp, Homo sapiens
  misc_feature: HEFZJCU01EG13Q.21.86.H09.1.454.heavy.3.raw
tcgtcgctcgcacgaccggtgctcgatttagtgctatagacttgggtttgggagatcatgagggtgtcctgtcgcaaatacagctgcagcagtccggtccaggactggtgaagccctcgcagaccctctcactcacctgcgacatctccggggagagtatctttatcaccactagtacttggaattggatcaggcagtccccgtcgagaggccttgagtggctgggaaggacattctacaggtccagatggtattctgattatgcagtgtctgtgagaagtcgaatggacatcactacagacccaccgaagaatcagttctccctgcatttgcactctgtgactcccgacgacacggctgtctactattgtgtaagacatcccacagggggctccacactcgaccctggggccagggaccctagtcaccgtctcctcagcctccaccaagggtccatcggtcttcccctggcgccctgctccaggagcgacctccgacg

SEQ ID NO: 459428 - DNA, 510 bp, Homo sapiens
  misc_feature: HEFZJCU01A32JQ.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgttgttttggccggtgaactactggggccagggcaccctggtcaccgtctcctcagcttccaccaagggcccatcggtcttcccctggcgccctgctccaggagcacctctggggcacagcggccctgggctgcctggtcaaggactacttcccatac

SEQ ID NO: 459429 - DNA, 529 bp, Homo sapiens
  misc_feature: HEFZJCU01CJYFS.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctgagctgaacagcctgtcatctgaggacacgggcttctacttctgtgcgaggagtaattactataacactgctcctttttacacctcccttgacttctggggccatggaaccccggtcaccgt

SEQ ID NO: 459430 - DNA, 502 bp, Homo sapiens
  misc_feature: HEFZJCU01CMPWU.48.49.E05.1.454.heavy.3.raw
agtatacatacacgaccggtgctcgatttagagcgactagcaacacacaaaggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgggggggtccctgagactctcctgtgcagcctctggactcacctttagtacctattggatgacctgggtccgccaatctccagggagggggctggagtgggtggccaacataaagggagatggaagtaagacatactatgcggattctgtgaagggccgattcaccatctccagagacaacgccaaggagtcactgtatctgcagatgaacagcctgagagccgaggacgcggctgtgtattactgtgcgagagatgtgaatccctttga

SEQ ID NO: 459431 - DNA, 518 bp, Homo sapiens
  misc_feature: HEFZJCU01CZ3PR.7.78.H01.1.454.heavy.3.raw
  modified_base (513)..(513): a, c, t, g, unknown or other
cgtgtctctacacgaccggtgctcgatttagtgtgagtagtttgggtttgggattcacgttgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttattttgtacgagagcgtcgtctgtcagtggaattgactactggggccagggaaccctggtcaccgtctcctcagcctccaccaagggcccatcggtcttcccctggcaccctcctccaagagcacctctgggggcacagcggccctgggctgcctggtcaaggactacttcctaganacacg

SEQ ID NO: 459432 - DNA, 518 bp, Homo sapiens
  misc_feature: HEFZJCU01A4LQN.3.17.B06.1.454.heavy.3.raw
agacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccagggaaggggctggagtgggttggccgttctagagacacaactaacagtgacaccgcacaatacgccgcgtcctgtgaaaggcagattcaccatctcaagagatgattcagagaactcactttatctgcaaatgaacagcctgagaacccgacgacacggccgtcatttatgtgtcatagacctaggatacaacgacgtggtacctggtattc

SEQ ID NO: 459433 - DNA, 534 bp, Homo sapiens
  misc_feature: HEFZJCU01EI71N.17.28.C06.1.454.heavy.3.raw
  modified_base (371)..(371): a, c, t, g, unknown or other
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgnggactctgtgaagggccgtttcaccatctccagagacaacgccaagaattcactgtatctacaactgaacagcctgagagtcgcagacacggccgtgtattactgtgcgagatgtagaaaagtatggctgtgtttattggggccagggagccctggtctaccg

SEQ ID NO: 459434 - DNA, 542 bp, Homo sapiens
  misc_feature: HEFZJCU01CBOP0.48.40.D07.1.454.heavy.3.raw
agtatacatacacgaccggtgctcgatttagtgatagagcgtaacaacagagggctcaccatggagttgggctgacctgggttttccttgtggctactttaagaggtgtcctgtgtgaggtgcacctgctggagtccgggggaggcttagttcggccgggggagtccctgagactcgcctgtgtagtgtctggattcaccttcaggaattacgacatggactgggtccgccaagctccagggaaggggctggagtgggtctcaaacgtgaacgttgatggcgggatcacaaaatacgcggactccgtgaaggccgcttcaccgtctccagagacaacggcgagaatactctgtatttgcagatgagaaatctgagaggcgaggacaccgcgctttattattgtacaacgtcgtttactttctaatgtggctcttacgaacgacatgactattgggtcgggggaacccgtggtcaccgtctcctcagcctccaccaagggcccatcggtcttcccctcggcaccctccctccagagcacctct

SEQ ID NO: 459435 - DNA, 521 bp, Homo sapiens
  misc_feature: HEFZJCU01BG23Y.47.46.E02.1.454.heavy.3.raw
agctcacgtacacgaccggtgctcgatttagactcatctacagggaaagggggagagaggagcccagccctgggattttcaggtgttttcatttggtgatcaggactgaaccgagagaactcaccatggagtttgggctgagctggctctttcttgtggctttttaaaaggtgtccagtgtgaggtgcaactgttggagtctgggggagacttagtacaccctggggggtccctgagactctcctgtgcagcctctggactcacctttagcaactctgtcatgggctgggtccgccaggctccggggaaggggctggagtgggtctcacgtatcaatcctgatggcagtgttataaattatgcggactccgtgaggggccgattcagcatctccagagacaacggcaagagtatactgtatctaggaaatgaacaatctgagagtcgacgatacggctgtctatcattgtgtttcgatgccttcggtccgcgggacttcgtggggccagggaaccctggtc

SEQ ID NO: 459436 - DNA, 488 bp, Homo sapiens; identical to SEQ ID NO: 447890
  misc_feature: HEFZJCU01AEOXJ.3.48.E04.1.454.heavy.3.raw

SEQ ID NO: 459437 - DNA, 507 bp, Homo sapiens
  misc_feature: HEFZJCU01AGL2Y.51.71.G05.1.454.heavy.3.raw
cgatcgtatacacgaccggtgctcgatttagtgtcgtcgcaagagagaggggctcttttaagaggcgtccagtgtcaggtgcagctggtggagtctggggggggcgtggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctatgttttactgtgcgagagggaactcgattacagcagccctcgaagaacatcatgatggctttgatatctggggccaagggacaatggtcattgtctcttcagcctccaccaaggggcccaagtcggtcttcccctggccaccctcctccaagacg

SEQ ID NO: 459438 - DNA, 517 bp, Homo sapiens
  misc_feature: HEFZJCU01BW0Y1.40.68.G02.1.454.heavy.3.raw
tctagcgactcacgaccggtgctcgatttagtcgatagtgaagggaaaggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaagggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgacggcccgagcgcgagtgtcgttttgtatcgtccgtttgatatggtcggggtaccgaagggacaagtggtccgtaccg

SEQ ID NO: 459439 - DNA, 489 bp, Homo sapiens
  misc_feature: HEFZJCU01C7P5A.19.53.E09.1.454.heavy.3.raw
tactctcgtgcacgaccggtgctcgatttagagagagtgtgttgggtttggggagctctgggagaggagccccagccctgagattcccaggtgtttccattcagtgatcagcactgaacacagaggactcaccatggagttgagactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggagtat

SEQ ID NO: 459440 - DNA, 461 bp, Homo sapiens
  misc_feature: HEFZJCU01BE37G.53.12.B01.1.454.heavy.3.raw
cgcgtatacacacgaccggtgctcgatttagtagtgtagattccgcgggcaccttgaccaactactatttacagtggttgcgacaggtccctggacaagggcttgagtggatgggaagaatcaaccctaatgatggaagtgcaacaaatgcgctgaaatttcagggcagaataaccctgaccagggacacgtccacgagcacagtctacatggaattgagcagcctaacatctgaagacacggccgtctattactgtgcgagagaatatcgttttatagtgggagctgccccaagatcgccattccactttgactactggggccagggaacactggtcaccgtctcctcagcctccaccaagggcccatcggtcttccccctggcaccctcctcccaagagcacctctgggggcacagcggccctgggctgcctggtcaaggactacttcctcgtactgcg

SEQ ID NO: 459441 - DNA, 518 bp, Homo sapiens; identical to SEQ ID NO: 444718
  misc_feature: HEFZJCU01D1R44.9.34.D01.1.454.heavy.3.raw

SEQ ID NO: 459442 - DNA, 513 bp, Homo sapiens; identical to SEQ ID NO: 447518
  misc_feature: HEFZJCU01CEX1I.19.67.G01.1.454.heavy.3.raw

SEQ ID NO: 459443 - DNA, 491 bp, Homo sapiens; identical to SEQ ID NO: 456408
  misc_feature: HEFZJCU01BLPUZ.19.53.E09.1.454.heavy.3.raw

SEQ ID NO: 459444 - DNA, 517 bp, Homo sapiens
  misc_feature: HEFZJCU01C4CCC.11.13.B02.1.454.heavy.3.raw
cgagagataccacgaccggtgctcgatttagtctagcgactttgggttctccttgttgctattttagaaggtgtccagtgtgaggcgcagatggtggggtctgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggcccgtcgggctcg

SEQ ID NO: 459445 - DNA, 372 bp, Homo sapiens; identical to SEQ ID NO: 444513
  misc_feature: HEFZJCU01D467N.5.23.C01.1.454.heavy.3.raw

SEQ ID NO: 459446 - DNA, 379 bp, Homo sapiens; identical to SEQ ID NO: 444450
  misc_feature: HEFZJCU01CJKAM.47.77.G11.1.454.heavy.3.raw

SEQ ID NO: 459447 - DNA, 519 bp, Homo sapiens; identical to SEQ ID NO: 446650
  misc_feature: HEFZJCU01DWETS.13.76.G10.1.454.heavy.3.raw

SEQ ID NO: 459448 - DNA, 515 bp, Homo sapiens
  misc_feature: HEFZJCU01DI9M2.52.78.H01.1.454.heavy.3.raw
cgcagtacgacacgaccggtgctcgatttagtgtgagtagtttgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaagggcttgagtggatggggtggaacaatcccaacagtggaggcaccggtcgcacagaatatgcgcggaagtttcagggcagggtcaccatgaccagcgacaggtccactaacacagcctacatggagctaagtagactgacatctgacgacacggccgtctattattgtgtgagagaggacccgatgacctcgaacatggacgtctgggggccac

SEQ ID NO: 459449 - DNA, 490 bp, Homo sapiens
  misc_feature: HEFZJCU01BGP37.19.71.G05.1.454.heavy.3.raw
tactctcgtgcacgaccggtgctcgatttagtgtcgtcgcaagagagagggggagagtctgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatctccggggacagagtcgctagcgacagtgttgcttggcactgggtcaggcagtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatatttactgtggaagtacgggcccccagtacgaacg

SEQ ID NO: 459450 - DNA, 384 bp, Homo sapiens; identical to SEQ ID NO: 444454
  misc_feature: HEFZJCU01CM8HZ.11.61.F06.1.454.heavy.3.raw

SEQ ID NO: 459451 - DNA, 531 bp, Homo sapiens
  misc_feature: HEFZJCU01CAM2G.51.26.C04.1.454.heavy.3.raw
cgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgtttattactgtgtgcgatccgacctcactggtacggggagttacttcctccgcaacggtatggacgtctggggccaagggaccacggtcaccgtctccttagcctcaccaagggcccatcggtcttcccctggcaccctcctccaagagcacctctc

SEQ ID NO: 459452 - DNA, 511 bp, Homo sapiens
  misc_feature: HEFZJCU01DRYGF.7.28.C06.1.454.heavy.3.raw
cgtgtctctacacgaccggtgctcgatttagagctcacgtattgggtttggggaggtctcagagaggagccttagccctggactccaaggccttccacagaggactcaccatggatttgggtctgagctgggttttccttgttgctattttagaaggtgtccagtgtgaggtgcagctggtggagtctggggggggcttagtccagcctggggagtccctaagactctcctgtgcagcctctggattcaactttggcaagtcttggatgggctgggtccgccaggctccagggaggcggctggagtgggtggccaacataaatgacgatgcaaaggagacctactatttggactctgtgaggggccgattcatcatctccagagacaacgccgacaactcactgtctctgctgatgagcagcctgagagccgacgacacggctatctattactgtgcgaaactctcattccgttcatctgaatacgtgggccagggaaccctggtcgtccg

SEQ ID NO: 459453 - DNA, 528 bp, Homo sapiens
  misc_feature: HEFZJCU01EYE72.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagacgtcccacgatcccggtgagccctaacgggccaggccggcccttttgactttcgtggggggccctaagggggaccg

SEQ ID NO: 459454 - DNA, 489 bp, Homo sapiens
  misc_feature: HEFZJCU01A4WPF.18.70.G04.1.454.heavy.3.raw
tacgagtatgcacgaccggtgctcgatttagtgtagtgtgaagggaaagggggaagaggaagactgacggtcctgccacaggtggtgctgggcacggtgggcactcgacacaacatttgcgccaggcccccggacaaaggcttgagtgggtgggatggatcaacgctgtcaatggtctcacaaaatattcacagaagttgcagggcagagtcaccattactagggacacatccgcgagaacagcctacatggagctgagcagcctgatatctgaagacacggctgtatattactgtgcgaggattgcagtggagagtccttactactactactactacatggacgtctggggcaaagggaccacggtcaccgtctcctcggcctccaccaagggccatcggtcttcccctggcgccctgctccaggagcacctccgagagcacagcggccctgggctggcctggtcaaggactacttcccatactcgta

SEQ ID NO: 459455 - DNA, 519 bp, Homo sapiens
  misc_feature: HEFZJCU01CRIA0.16.86.H09.1.454.heavy.3.raw
tgtactactccacgaccggtgctcgatttagtgctatagactgggtttggggactttctgagagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggtcccatcagaggtggtggcttctactggagctggatccgccagcacccagggaaggcctggagtggattgggaacatctattacagcgggagcaccaactacaacccgtccctcaagagtcgagttaccatttcattaaacacgtctaagaaccagttctccctgaagctgacctttgtgactgccgcggacacggccgtgtattactgtgcgagagacccctccgatagcagtggctggtccactaggtttgactactggggccagggaagcttggtcaccgtctcctcagcct

SEQ ID NO: 459456 - DNA, 506 bp, Homo sapiens
  misc_feature: HEFZJCU01B2XKX.52.35.D02.1.454.heavy.3.raw
cgcagtacgacacgaccggtgctcgatttagcacacgatagttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaagggcccatcggtcttcccctggcaccctcctccaagagcacctctgggggcacagcggccctgggctgcctggtcaaggactacttcctatacgatcg

SEQ ID NO: 459457 - DNA, 507 bp, Homo sapiens
  misc_feature: HEFZJCU01DGZBM.51.5.A05.1.454.heavy.3.raw
cgatcgtatacacgaccggtgctcgatttagatagatagacagggcacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacgggtgtctattctgtgcgagactgcccggtcctgcacctcgtgtggccccaatttggtttacc

SEQ ID NO: 459458 - DNA, 513 bp, Homo sapiens
  misc_feature: HEFZJCU01D39PS.4.57.F02.1.454.heavy.3.raw
agcactgtagcacgaccggtgctcgatttagctcgatatagttgggtttggggggaagaggaagactgacggtcctcccaggagttcaggtgctgggcaccgtgggcatgggggaggcgtggtccagcctggggggtccctgagactctcctgtgcagcgtctggattcgccttcagtgcctatggcatgcactgggtccgccaggctccaggcaaggggctggaatgggtggcagttatatggtttgatggaactaacaaattctatgcagactccgtgaagggccgattcaccatctccagagacaatttcgagaacacattgaatctacagatgaacagtctgagagccgaggacacggctgtctattattgtgcgagagtaagtggtcatggtcctttgaccagtggggccagggaaccctggtcaccgtctcctcagcttccaccaagggcccatcggtcttcccctggcgccctgctccaggagcacctctggggcacagcggcccg

SEQ ID NO: 459459 - DNA, 511 bp, Homo sapiens
  misc_feature: HEFZJCU01C5JEB.17.25.C03.1.454.heavy.3.raw
cgtagactagcacgaccggtgctcgatttagtagtgtagatttgggtttggggaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccattcctccgggacagacttaccatgaccacgaactcctccataaacacagcctacatggagttgaggagcctgacatctgacgacacggccgtctattactgtgcgagagtcccagatccggtgagcctacggcagcggcctttgacttcgtggggccaggggaccg

SEQ ID NO: 459460 - DNA, 483 bp, Homo sapiens; identical to SEQ ID NO: 444924
  misc_feature: HEFZJCU01BYTU0.10.35.D02.1.454.heavy.3.raw

SEQ ID NO: 459461 - DNA, 373 bp, Homo sapiens; identical to SEQ ID NO: 445969
  misc_feature: HEFZJCU01DZ093.49.58.F03.1.454.heavy.3.raw

SEQ ID NO: 459462 - DNA, 504 bp, Homo sapiens
  misc_feature: HEFZJCU01D4J9X.9.33.C11.1.454.heavy.3.raw
tgatacgtctcacgaccggtgctcgatttagagtgagctcgttgggtttgggggcgtggtccagcctgggaggtccctgagactctcctgtgcaggctctggattcaccttcagtaactacggcgtgcactgggtccgccaggctccaggcaagggcttggagtggctggcagttgtttcatctgaaggaagtgttcaatactatacagactccgtgaagggccgattcaccatctccagacacaattccaagaacacgatgtatctgcaaatggacagcctaagagttgaggacacggctgtttattactgtacgaaagaggggggatacagtggcagctccaagtactactttgacttctggggccagggaaccctggtcaccgtctcctcagcctccaccaagggcccatcggtcttcccctggcgccctgctccaggagcacctccgagagcacagccggccctgggctgcctggtcaaggactacttccagacgtatca

SEQ ID NO: 459463 - DNA, 372 bp, Homo sapiens; identical to SEQ ID NO: 444513
  misc_feature: HEFZJCU01DULSA.5.23.C01.1.454.heavy.3.raw

SEQ ID NO: 459464 - DNA, 509 bp, Homo sapiens
  misc_feature: HEFZJCU01BA36Z.48.74.G08.1.454.heavy.3.raw
  modified_base (499)..(499): a, c, t, g, unknown or other
agtatacatacacgaccggtgctcgatttagtagctctatcaggggaggtctgggagaggagccccagccctgagattcccaggtgtttccattcagtgatcagcactgaacacagaggactcaccatggagttgggactgagctggattttccttttggctcttttaacaggtgtccagtgtgaagtgcagctggtggagtctgggggaggcttggtacagcccggcaggtccctgagactctcctgtgcagcctctggattcatctttggtgattatgccatgcactgggtccggcgaattccagggaagggcctggagtgggtctcaggtattagttgggatggtgacagtataggctatgcggactctgtgaggggccgattcaccatcaccagggaaaacgccaataactccctgtgtctacaatgaacaatctgagacctgaaagacacggccttgttattttgtgtaaagatattctccgacaattatggtnatcggtgggt

SEQ ID NO: 459465 - DNA, 482 bp, Homo sapiens
  misc_feature: HEFZJCU01C20Q1.19.67.G01.1.454.heavy.3.raw
tactctcgtgcacgaccggtgctcgatttagagtatacatattgggcttggtccagcctgggcggtctctgagactgtcctgtgaaccctctggggtctccgtcagcagcgactgtattgcctgggtccgccaggctccggggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctggtggacagatcactggggccagggaaccctggtcaccgtctcctcagcctccaccaagggcccatcggtcttccccctggcgccctgctccaggagcacctccgacgagcacagcggccctgggctgcctggtcaaggactacttcccacgagagta

SEQ ID NO: 459466 - DNA, 509 bp, Homo sapiens; identical to SEQ ID NO: 445157
  misc_feature: HEFZJCU01CHMVJ.4.67.G01.1.454.heavy.3.raw

SEQ ID NO: 459467 - DNA, 505 bp, Homo sapiens
  misc_feature: HEFZJCU01BT8OH.12.79.H02.1.454.heavy.3.raw
  modified_base (485)..(485): a, c, t, g, unknown or other
atacgacgtacacgaccggtgctcgatttagtgtcacacgaagggaaaggggacccaaaaaccacacccctccttgggagaatcccctagatcacagctcctcaccatggactggacctggagcatccttttcttggtgacagtagcaacaggtgtccactcccagttgcatctggagcagtctggagctgaggtgaaggagcctggggcctcagtaaaatctcctgcaagtcttctggttacgcactcaccgccaatggtatcagctggctgcgacaggcccctggacaaggtcttgagtggatgtcatggatcagcactttcaatggagacacaaagtatggagagaacttccagggcagagtcaccatgaccactgacagatcaacgaacatagcctacttggaactgaggggcctgaggtctgacgacacggccctctattattgtgcgagattaattttcgtatttgttctggtggtgtntgttcaatgtttgaccattc

SEQ ID NO: 459468 - DNA, 396 bp, Homo sapiens; identical to SEQ ID NO: 445818
  misc_feature: HEFZJCU01D2H25.16.68.G02.1.454.heavy.3.raw

SEQ ID NO: 459469 - DNA, 346 bp, Homo sapiens
  misc_feature: HEFZJCU01DMEXJ.11.81.H04.1.454.heavy.3.raw
cgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgtagctcttttaagaagtgattcatggagaaatagagagactgagtcctccaccaagggcccatcggtcttccccctggcaccctcctccaagagcacctctggggcacagcggccctgggctgcctggtcaaggactacttccgtatctctcg

SEQ ID NO: 459470 - DNA, 492 bp, Homo sapiens
  misc_feature: HEFZJCU01AKYIR.51.38.D05.1.454.heavy.3.raw
  modified_base (358)..(358): a, c, t, g, unknown or other
cgatcgtatacacgaccggtgctcgatttagtatctgatagtgggtttgggctcaactctcttgtccagtgttatgtgcagctggtggagtctgggggaggcgtggtccagcctgggaggtccctgagactcgcctgtaaaccgtccggattcaccttcagtaactatgcaatgcactgggtccgccaggctccaggcaaggggctggactgggtggcaggcatatcatttgatggaagcaagaagtactatgcagactccgtgaagggccgattcaccatctccagagacagttccgatgacacagtctatctacacatgagcagtgtgagacctgacgacacggctcttttttacngtgcgccaggaagcagtggctggccacatcatgcttttgatatctggagccaagggacaatggtcatcgtctcttcggcctccaccaagggcccatcggtcttcccctggccaccctcctccaagagcacctcg

SEQ ID NO: 459471 - DNA, 479 bp, Homo sapiens
  misc_feature: HEFZJCU01B5441.21.14.B03.1.454.heavy.3.raw
tcgtcgctcgcacgaccggtgctcgatttagtgtgagtagtttgggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaagggcccatcggtcttccccctggcaccctcctccaagagcacctctgggggcacagcggccctgggctgcctggtcaaggactacttcccgagcgacga

SEQ ID NO: 459472 - DNA, 396 bp, Homo sapiens; identical to SEQ ID NO: 444469
  misc_feature: HEFZJCU01C17NN.47.46.E02.1.454.heavy.3.raw

SEQ ID NO: 459473 - DNA, 510 bp, Homo sapiens
  misc_feature: HEFZJCU01A6STT.14.25.C03.1.454.heavy.3.raw
cgtctagtaccacgaccggtgctcgatttagtagtgtagatttgggtttgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgaccctggggccagggaaccctggtcaccgtctcctcagcctccaccagggcccatcggtcttcccctggcaccctcctccaagagcacctctgggggcacagcggccctgggctgactggtcaggactacttccgtactacg

SEQ ID NO: 459474 - DNA, 510 bp, Homo sapiens
  misc_feature: HEFZJCU01BINPQ.52.22.B11.1.454.heavy.3.raw
cgcagtacgacacgaccggtgctcgatttagacgacagctcagggggggagaggagccccagccgtgagattcccaggagattccacttggtgatcagcactgaacacagacctccaaccatggagtttgggcttagctgcgttttccttgttgctattttaaaaggtgtccaatgtgaggtgcagctggttgagtctgggggaggcttggtacagccagggcggtccctgagactctcctgtgtaacctcaggattcatgtttggtgattatggaatgacctgggtccgccaggctccaggggagggcctggagtgggtagctttcgttagcagaaagactgaaggtgggacaacagaatacgccgcgtctgtgaaaggcagatttatcatctcaagagacgattccaaaggcatcgcctatctgcaaatgaacagcctgaaaaccgaggacacagccgtgtattttgtactagagtcttcttgtattactatgatactagtggtttta

SEQ ID NO: 459475 - DNA, 519 bp, Homo sapiens; identical to SEQ ID NO: 446650
  misc_feature: HEFZJCU01ESD47.13.76.G10.1.454.heavy.3.raw

SEQ ID NO: 459476 - DNA, 515 bp, Homo sapiens
  misc_feature: HEFZJCU01CYXAC.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccaggggaagggactggagcatattgggtatgtctttcacagtgggaggactgactacaacgcctccctcaggagtcgggtcaccatatcagtagacacgtccaagagccagttctccctgaagctgagggctgtgagcgacgcagacacggccgtgtattactgtgcgagactggccgcaacagactacggtggcaactcctatgcttttgatatctggggccaagggacaatggtcaccgtctcttcagcctcaccaagggcccatcggtcttcccctggcaccctcctccaagagcacctctgggggcacagcggcccg

SEQ ID NO: 459477 - DNA, 522 bp, Homo sapiens; identical to SEQ ID NO: 458543
  misc_feature: HEFZJCU01EBXXM.3.82.H05.1.454.heavy.3.raw

SEQ ID NO: 459478 - DNA, 395 bp, Homo sapiens; identical to SEQ ID NO: 444517
  misc_feature: HEFZJCU01D1YM4.16.68.G02.1.454.heavy.3.raw

SEQ ID NO: 459479 - DNA, 514 bp, Homo sapiens; identical to SEQ ID NO: 446900
  misc_feature: HEFZJCU01CLV5E.10.53.E09.1.454.heavy.3.raw

SEQ ID NO: 459480 - DNA, 520 bp, Homo sapiens
  misc_feature: HEFZJCU01ES5YE.3.23.C01.1.454.heavy.3.raw
agacgcactccacgaccggtgctcgatttagtacacgtgatcaggactgaacacagaggactcaccatggactttgggctgaggtggattttccttgctgccattttaaaaggtttccactgtgagctgcgactggtggcgtctgggggaggcttggtgcagccgggtgggtccctgcgactctcctgtgcaatttctgaagccccttccaatacagtgtggatgaattgggtccgccaggctccagggaaggggctggagtgggttggccatataaaaagtaagactgctggtgagacaacagactacgctgctgccttcagaggcagattcaccatcttcagagatgaatcacagagcactctgtttctgcaatgaacagcctggaagacgcggacacagccatgtattattgtacattaggacactatagtcccgtggggccgagggaaccctcgtccaccgtctcctcacgcctccaccaacgggcccagtcggtccttccccctcggccgtcccg

SEQ ID NO: 459481 - DNA, 500 bp, Homo sapiens
  misc_feature: HEFZJCU01CM2GM.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaatttattactgtgcgagggtttatgtgttggaacgtggtacaccggaaaactggttcgaccctggggccagggaaccctggtcgtcgtctcgtctgcctccaccaagggccatcggtcttcccctggcgccctgctccaggagcacctccgagacgcacagcggccctgggctggcctggtcaaggactacttccgtactagacg

SEQ ID NO: 459482 - DNA, 530 bp, Homo sapiens
  misc_feature: HEFZJCU01DPBLW.49.43.D10.1.454.heavy.3.raw
agtcgagagacacgaccggtgctcgatttagactagcagtaaggggctgagagaggagcccagccctgggattttcaggtgttttcatttggtgatcaggactgaacagagagaactcaccatggagtttgggctgagctggctttttcttgtggctattttaaaaggtgtccactgtgaggtgcaactgttggaatctgggggagacttggtaaagccgggggggtccctgagactctcctgtgcagtctcgggattcacctttagagtctatgccatgcactgggttcgccaggccccagggaaggggctggagtgggtctctgccattagtggaagtggtgatctcagatactacggagactccgtgaagggccggttcaccatctccagagacaactccaagaatacgctctatctacacatgaaaaacctaagagccgacgacacggccgtctattactgtgcaaagtgggtcacggactacgatgatactagtggctattactccggtgactactttgactacg

SEQ ID NO: 459483 - DNA, 527 bp, Homo sapiens
  misc_feature: HEFZJCU01B61Y8.12.39.D06.1.454.heavy.3.raw
atacgacgtacacgaccggtgctcgatttagtgacatctcgcagttctttgggctcaactctcttgcccactctcaggtgcaactggtgcaatctgggtctgagttgcagaagcctggggcctcagtgaacatttcctgcaagtcttctgggtacacctttaataattatgccatgaattgggtgcgacagacccctggacaagggcttcagtggatgggatggatcaacaccaacaccggcaacccaacctacgcccagggtttcaccggacgctttgtcttctccttggatacctctgtcagggcggcgtatctgcagatcaccagccttcaggctgaggacactgccatttattactgtgcgagagagggggagagtggagtagaacgtaaatacgggaaaccgtttgacttttgggccagggaaccctggtcaccgtctcctcagcctccaccaagggcccatcggtcttccccctggcaccctcctccaagagcacctctgggggcacagcggccctggctg

SEQ ID NO: 459484 - DNA, 524 bp, Homo sapiens; identical to SEQ ID NO: 445902
  misc_feature: HEFZJCU01A401R.9.78.H01.1.454.heavy.3.raw

SEQ ID NO: 459485 - DNA, 518 bp, Homo sapiens
  misc_feature: HEFZJCU01BO7IR.9.34.D01.1.454.heavy.3.raw
tgatacgtctcacgaccggtgctcgatttagatcgtctgtgttgggtctgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagagcacctctgggggcacagcggccctgggctgcctggtcaaggactactccagacgtatca

SEQ ID NO: 459486 - DNA, 513 bp, Homo sapiens; identical to SEQ ID NO: 445134
  misc_feature: HEFZJCU01ECAB2.3.34.D01.1.454.heavy.3.raw

SEQ ID NO: 459487 - DNA, 500 bp, Homo sapiens
  misc_feature: HEFZJCU01B50FF.13.87.H10.1.454.heavy.3.raw
tcacgtactacacgaccggtgctcgatttagcagtactgcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgcagctggtggagtctgggggaggcttggtacagcctggcaggtccctgagactctcctgtgcagcctctggattcacctttgatgattatgccatgcactgggtccgacaagctccagggaagggcctggagtgggtctcaggtattagttggaatagtggtagcataggctatgcggactctgtgaagggccgattcaccatctccagagacaacgccaagaactcctgtatctgcaaatgaacagcctgagagctgaggacacggccttgtattattgtgcaaagataccaacccttacgta

SEQ ID NO: 459488 - DNA, 498 bp, Homo sapiens; identical to SEQ ID NO: 445952
  misc_feature: HEFZJCU01DFGAV.11.71.G05.1.454.heavy.3.raw

SEQ ID NO: 459489 - DNA, 507 bp, Homo sapiens; identical to SEQ ID NO: 448429
  misc_feature: HEFZJCU01B3MYM.3.17.B06.1.454.heavy.3.raw

SEQ ID NO: 459490 - DNA, 516 bp, Homo sapiens; identical to SEQ ID NO: 448668
  misc_feature: HEFZJCU01COQX5.19.86.H09.1.454.heavy.3.raw

SEQ ID NO: 459491 - DNA, 503 bp, Homo sapiens
  misc_feature: HEFZJCU01BPE1M.51.81.H04.1.454.heavy.3.raw
cgatcgtatacacgaccggtgctcgatttagtagtgtagattcgcggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaaatgaacagcctgagagctgaggacacggctattgtttactgtgcgagagggaactcgattacagcacgtcccg

SEQ ID NO: 459492 - DNA, 495 bp, Homo sapiens
  misc_feature: HEFZJCU01EVX8M.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactcccctgaggggccgattcaccatctcccagagacaattcccagaacacggtctatctgcacctgaccagcctgagaactgacgacacgtctctctactactgtgcgagagagttgacgagtct

SEQ ID NO: 459493 - DNA, 523 bp, Homo sapiens
  misc_feature: HEFZJCU01AL80S.52.26.C04.1.454.heavy.3.raw
cgcagtacgacacgaccggtgctcgatttagtctagcgactttgggtttggggtctgggagaggagcccagcactgggattccgaggtgtttccattcagtgatctgcactgaacacagaggactcgccatggagtttgggctgagcgtggttttccgtgttaggctattttaaaaggtgtccagtgtggagtgcaggtggtggagtctgggggaggcttggtccagcctggtggttccctgagactctcctgtgcagcctctggattctccgtcagtagcaactacatgagctgggtccgccaggctccagggaagggctggagtgggtctcaagtctttatgtcggtggtaccacatattatgctgactccgtgaagggccgattcaccatctccagagacgagtccaggaacagcctgtttcttcaaatggacagtctgagacctgacgacacggctgtctattactgtgcgagagaacccgaggggggcgggagcagccccgtaacttctggggccaac

SEQ ID NO: 459494 - DNA, 520 bp, Homo sapiens; identical to SEQ ID NO: 447654
  misc_feature: HEFZJCU01EP6MV.10.79.H02.1.454.heavy.3.raw

SEQ ID NO: 459495 - DNA, 469 bp, Homo sapiens
  misc_feature: HEFZJCU01DYSYV.16.78.H01.1.454.heavy.3.raw
tgtactactccacgaccggtgctcgatttagtgtgagtagtttgggtttgggctcaactctcctgtgcagcctctggattcaccttgaggggaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgtgggagccgtaacttcgggggactacctcgacccctggggccagggaatactggtcaccgtctcctcagcctccaccaagggcccatcggtcttcccctggcaccctcctccaagagcacctctgggggcacagcggccctgggctgcctggtcaaggactacttccgagtagtaca

SEQ ID NO: 459496 - DNA, 496 bp, Homo sapiens
  misc_feature: HEFZJCU01B8S65.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgttattattgtgcaataagaattgcaacgatgctttgatatgtgggaccg

SEQ ID NO: 459497 - DNA, 534 bp, Homo sapiens
  misc_feature: HEFZJCU01BV48E.53.68.G02.1.454.heavy.3.raw
cgcgtatacacacgaccggtgctcgatttagtcgatagtgaagggaaaggggcacaagaacatgaaacacctgtggttcttcctcctcctggtggcagctcccagatgggtcctgtcccaggtgcagctgcagcagtggggctcaggactgttgaagccttcggagaccctgtccctcacgtgcgctgtctatggtgggtcattcagtgattattattggacctggatccgtcaggccccagggaaggggctggagtggatagcggaaatcaatcatagtggaaagactacctacaacccgtccctcaagagtcgagtcaccttatcggtagacacgcccaagaagcagttctccctgagggtgacgtctgtgaccgccgcggacacggctgtctattactgtgcgagaggccccttagtttcggtttttggactggttctcccatggaatccctacttgagtactggggccgcggagcctggtcaccgtctcctcagcctccaccaacgggccatcggtctcccctggcacct

SEQ ID NO: 459498 - DNA, 406 bp, Homo sapiens; identical to SEQ ID NO: 445177
  misc_feature: HEFZJCU01AZUAJ.51.77.G11.1.454.heavy.3.raw

SEQ ID NO: 459499 - DNA, 514 bp, Homo sapiens
  misc_feature: HEFZJCU01DOLQ1.47.55.E11.1.454.heavy.3.raw
agctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaatgaacaatctgagagtcgacgatacggctgtctatcattgtgttttcgatgccttcggtccgtcgggacttcgtggggccagggtaacccg

SEQ ID NO: 459500 - DNA, 514 bp, Homo sapiens
  misc_feature: HEFZJCU01DUEZ7.12.1.A01.1.454.heavy.3.raw
atacgacgtacacgaccggtgctcgatttagacgtctcatcagggggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagtagtagttattactactggggctggatccgccagcccccaggggaggggctgaagtggattgggagtgtctattatagtgggatcacctactacaacccgtccctcaagagtcgagtcaccatatccgtcgacacgtccaagaaccagttctccctgaagctgagctctgtgaccgccgcagacacggctgtgtattactgtgcgagacagccaagacagatttttggagttggttactgttggactactttgactactggggccagggaaccctggtcc

SEQ ID NO: 459501 - DNA, 494 bp, Homo sapiens
  misc_feature: HEFZJCU01A4XC1.14.25.C03.1.454.heavy.3.raw
cgtctagtaccacgaccggtgctcgatttagtagtgtagatttgggtttggggagacgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgaatgttgta

SEQ ID NO: 459502 - DNA, 486 bp, Homo sapiens
  misc_feature: HEFZJCU01AEL2A.51.81.H04.1.454.heavy.3.raw
  modified_base (446)..(446): a, c, t, g, unknown or other
cgatcgtatacacgaccggtgctcgatttagtagtgtagattcgcggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtctggggggggctggtccaggctgggaggtccctgagactctcctgtgcagcctctggattcaccttcagtacccatgaaatgcactgggtccgccaggctccaggcaaggggctggagtgggtggcagttatatcctatgatggaagcaataagcactacgcagagtccgtgaagggccgattgaccatctccagagacaactcgaagaatacggttcttctacaatgaacagcctgagagntgaggacacggctatgttttactgtgcgagagggaactcg

SEQ ID NO: 459503 - DNA, 488 bp, Homo sapiens; identical to SEQ ID NO: 452671
  misc_feature: HEFZJCU01C0QMA.40.22.B11.1.454.heavy.3.raw

SEQ ID NO: 459504 - DNA, 500 bp, Homo sapiens; identical to SEQ ID NO: 445080
  misc_feature: HEFZJCU01BO8B7.3.81.H04.1.454.heavy.3.raw

SEQ ID NO: 459505 - DNA, 518 bp, Homo sapiens
  misc_feature: HEFZJCU01EJKSV.2.81.H04.1.454.heavy.3.raw
acgctcgacacacgaccggtgctcgatttagtagtgtagattcgcggggctgccctttggctttggagatggttttctcgatgggggctgggaggtctcagagaggagccttagccctggactccaaggcctttccacttggtgatcagcactgagcacagaggactcaccatggaattggggctgagctgggttttacttgttggtattttagaaggtgtccagtgtgaggtgcagctggtggagtccgggggaggctgggtccagcctgggggtccctgagactctcctgttcagcctctggattcacctttagtaggttttggatgagttgggtccgccaggctccagggaagggctggagtgggtggccaacatagagtacgatggaagtgagaaaactatgtggactccgtgaagggccgattcaccatctccagagacaacgacaagaatttagtgtatctgcaaatgagcagcctgagagccgaggacacggctgtgtattattgtgcgag

SEQ ID NO: 459506 - DNA, 482 bp, Homo sapiens; identical to SEQ ID NO: 457134
  misc_feature: HEFZJCU01EE8F5.10.35.D02.1.454.heavy.3.raw

SEQ ID NO: 459507 - DNA, 503 bp, Homo sapiens; identical to SEQ ID NO: 445995
  misc_feature: HEFZJCU01BRFCM.17.25.C03.1.454.heavy.3.raw

SEQ ID NO: 459508 - DNA, 517 bp, Homo sapiens; identical to SEQ ID NO: 446039
  misc_feature: HEFZJCU01EFEBK.9.70.G04.1.454.heavy.3.raw

SEQ ID NO: 459509 - DNA, 497 bp, Homo sapiens
  misc_feature: HEFZJCU01A30AT.51.33.C11.1.454.heavy.3.raw
cgatcgtatacacgaccggtgctcgatttagagtgagctcgttgggtttggggagctctgggagaggagccccagccctgagattcccaggtgtttccattcagtgatcagcactgaacacagaggactcaccatggagttgggactgagctggattttccttttggctattttaaaaggtgtccagtgtgaagtgctactggtggagtctgggggaggcctggtacagcctggcaggtccctgagactctcctgtgcagcctctggattcacctttgatgattatgccatgcactgggtccggcaagctccagggaagggcctggagtgggtctcacgtattagttggaatagtggtagtatagcctatgcggactctgtgaagggccgattcaccatctccagagacaacgccaagaactccctgtatctgcaaatgaacagtctgagagctgaggacacggccttgtattactgcgacaaaggcccaaggcaac

SEQ ID NO: 459510 - DNA, 315 bp, Homo sapiens; identical to SEQ ID NO: 444422
  misc_feature: HEFZJCU01CKZOS.47.84.H07.1.454.heavy.3.raw

SEQ ID NO: 459511 - DNA, 494 bp, Homo sapiens
  misc_feature: HEFZJCU01BH0ES.3.26.C04.1.454.heavy.3.raw
agacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctctggggccgtggcaccctgctgactgtctcctcagcctccaccaagggcccatcggtcttcccctggcgccctgctccaggagcacctccgagagcacagcggccctggctgcctggtcaagactac

SEQ ID NO: 459512 - DNA, 500 bp, Homo sapiens
  misc_feature: HEFZJCU01BJL49.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagaattgcaaacgatgcttttgatatgtggggaccg

SEQ ID NO: 459513 - DNA, 539 bp, Homo sapiens
  misc_feature: HEFZJCU01BR1LB.17.28.C06.1.454.heavy.3.raw
cgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctggggggtccctgagactctcctgtgcagcctccggattccccttcagtagttattggatgacttgggtccgccagactccagggaaggggctggagtgggtggccaacataaagcaagatggaactgccgagttttacgtggactctgtgaagggccgtttcaccatctccagagacaacgccaagaattcactgtatctacaactgaacagcctgagagtcgcagacacggccgtgtattactgtgcgagatggtaggaaaagtaatggctgtgtttagttggggccagggagcccgtggtctaccg

SEQ ID NO: 459514 - DNA, 508 bp, Homo sapiens
  misc_feature: HEFZJCU01DYVW2.48.34.D01.1.454.heavy.3.raw
agtatacatacacgaccggtgctcgatttagatcgtctgtgttgggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggccgcctgctccaggagcacctccgagagcacagcggccctcgggctgcctcggtcaaggactacttcctatgtatactctgac

SEQ ID NO: 459515 - DNA, 519 bp, Homo sapiens; identical to SEQ ID NO: 452709
  misc_feature: HEFZJCU01BMFLW.3.82.H05.1.454.heavy.3.raw

SEQ ID NO: 459516 - DNA, 400 bp, Homo sapiens; identical to SEQ ID NO: 444452
  misc_feature: HEFZJCU01DC3XP.47.24.C02.1.454.heavy.3.raw

SEQ ID NO: 459517 - DNA, 435 bp, Homo sapiens; identical to SEQ ID NO: 447770
  misc_feature: HEFZJCU01D1KNX.40.27.C05.1.454.heavy.3.raw

SEQ ID NO: 459518 - DNA, 496 bp, Homo sapiens; identical to SEQ ID NO: 444697
  misc_feature: HEFZJCU01CZG82.16.37.D04.1.454.heavy.3.raw

SEQ ID NO: 459519 - DNA, 531 bp, Homo sapiens
  misc_feature: HEFZJCU01E2S98.17.25.C03.1.454.heavy.3.raw
cgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacactggagttgaggagcctgacatctgacgacacggccgtcgtattactgtgtcgagagtcccgacgaactccggtggtacgccgttaaccggccgtacgcgggcccttttcggtaaccgtttcgtc

SEQ ID NO: 459520 - DNA, 502 bp, Homo sapiens
  misc_feature: HEFZJCU01DQJEJ.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaaggccgttcaccctctccagagacacttccaacacatcttgtatcttcacatgcacaatctgagagtcgacgacacggccacctattattgtgcgcgacatgactacgctcaattctggggccagggacg

SEQ ID NO: 459521 - DNA, 528 bp, Homo sapiens
  misc_feature: HEFZJCU01B0G7P.11.25.C03.1.454.heavy.3.raw
cgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccgaagggaccac

SEQ ID NO: 459522 - DNA, 514 bp, Homo sapiens
  misc_feature: HEFZJCU01EA9HF.15.67.G01.1.454.heavy.3.raw
tctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttagttattttagaaggtgtccagtgtgaggtgcacttggtggagtctgggggaggcttggtccagccgggggggtccctgagactctcctgtgcagtctctggattcacccttagaagttattggatgacctgggtccgccaggctccagggaaggggctggagtgggtggccaacataaacaaagacggaagtcagaaaaactatgtggactctgtgaacggccgattcaccatctccagagacaacgccaagaattcactgtatttgcaaatgaacagcctgagaggcgaggacacggccgtgtattattgtgcgcgagatgatagtagactctacagtagcaggtggta

SEQ ID NO: 459523 - DNA, 516 bp, Homo sapiens; identical to SEQ ID NO: 448668
  misc_feature: HEFZJCU01CGJOS.19.86.H09.1.454.heavy.3.raw

SEQ ID NO: 459524 - DNA, 518 bp, Homo sapiens
  misc_feature: HEFZJCU01DN0LS.47.78.H01.1.454.heavy.3.raw
agctcacgtacacgaccggtgctcgatttagtgtgagtagtttgggtttggggctctgggagaggagccccagccttgggattcccaagtgttttcattcagtgatcaggactgaacacagaggactcaccatggagtttgggctgagctggattttcctcggtgctcttttaaaaggtgtccagtgtggggtgcacctgatggagtctgggggaggcctcataaagccgggggggtcccttaaactctcctgcgcagcgtctggatttcctttcagtcaagtctggataagctgggtccgccaggctccagggatgggcctggagtgggttggccgtgtcaagagcagaactgatggtgcgacatctgaatacgctgcacccgtgaaaggcagattcaccatctccagagatgattcaataaatatgtcatatctacaaatggatagcctgaaaatcgaggatacaggtgtttattactgttccacagggaatgcggttctctggggccgagggact

SEQ ID NO: 459525 - DNA, 517 bp, Homo sapiens
  misc_feature: HEFZJCU01BK9KL.48.65.F10.1.454.heavy.3.raw
agtatacatacacgaccggtgctcgatttagctacgctctaagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttctatggtgggtccttcagtggttactactggagctggatccgccagcccccagggaaggggctggagtggattggggaaatcaatcatagtggaagcaccaactacaacccgtccctcaggagtcgagtcaccatatcagtagacacgtccaagaaccagttctccctgaagctgagctctgtgaccgccgcggacacggctgtgtattactgtgcgagagcggatattgtagtagtaccagctgctattttgtccggtggttcgaccctggggccagggaaccctggtcaccgtctcctcagcct

SEQ ID NO: 459526 - DNA, 506 bp, Homo sapiens
  misc_feature: HEFZJCU01AO447.12.33.C11.1.454.heavy.3.raw
atacgacgtacacgaccggtgctcgatttagagtgagctcgttgggtttggggggaagaggaagactgacggtccctgagactctcatgtgcagggtctggattcaacttttacgattatggcatgacctgggtccgccaagctccagggaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgttgcgagagccctcggcagaagtctggactactactattatggtatggacgtctggggccaagggaccacggtcatcgtctcctcagcctccaccaagggcccatcggtcttcccctggcaccctcctccaagagcacctctgggggcacagcggccctgggctgcctggtcaaggactacttcctacgtcgtat

SEQ ID NO: 459527 - DNA, 495 bp, Homo sapiens
  misc_feature: HEFZJCU01DHE49.10.71.G05.1.454.heavy.3.raw
catagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatggagactccttcaagggccgattcaccatctccagagacaattccaagaacatggtgtatctgcaaatgaccagcctgagagccgaggacacgggttgtttattactgtgggagaatcctagtggc

SEQ ID NO: 459528 - DNA, 516 bp, Homo sapiens
  misc_feature: HEFZJCU01AEU67.19.67.G01.1.454.heavy.3.raw
tactctcgtgcacgaccggtgctcgatttagagtatacatattgggtttgggggggagaggagcccagcactgggattccgaggtgtttccattcggtgctcagcactgaacacagaggactcaccatggagttttggctgacctgggttttccttgctgcaatttcaggaggtgtccagtgtgaggtgcaactggtggagactggcggaggcttgggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggcgatggctgggtggacagatcactgggggccac

SEQ ID NO: 459529 - DNA, 396 bp, Homo sapiens; identical to SEQ ID NO: 444469
  misc_feature: HEFZJCU01B8KD3.47.46.E02.1.454.heavy.3.raw

SEQ ID NO: 459530 - DNA, 463 bp, Homo sapiens; identical to SEQ ID NO: 445513
  misc_feature: HEFZJCU01ARYJF.2.28.C06.1.454.heavy.3.raw

SEQ ID NO: 459531 - DNA, 479 bp, Homo sapiens
  misc_feature: HEFZJCU01BR4EF.22.36.D03.1.454.heavy.3.raw
acatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaagacctctatttttgggccgcggccgactactggggccagggcaccctggtcaccgtctcttcagcctccaccaagggcccatcggtcttcccctggcgcctgctccaggagcacctccgagagcacagccggccctgggctgcctggtcaaggactattccacgcgtatgt

SEQ ID NO: 459532 - DNA, 516 bp, Homo sapiens
  misc_feature: HEFZJCU01DNWRG.49.57.F02.1.454.heavy.3.raw
agtcgagagacacgaccggtgctcgatttagctcgatatagttgggtttggggttgaagtgaagaagcctggggcctcggtgaaggtttcctgcaaggcatctggatacagcttgaccaactactatatacagtgggtgcgacaggcccctggacaagggcttgagtggatgggaagaatcaaccctaatgatggaagtacaacaaacgcgcagaaatttcagggcagaataaccctgaccagggacacgtccacgagcacagtctacatggaattgagcagcctgagatctgaagacacggccgtctattactgtgccagagaatatcgttttatagtgggagctgccccacgatcgccattccactttgactactggggccagggaacactggtcaccgtctcctcagcctccaccaagggcccatcggtcttcccctggcaccctcctccaagagcacctctgggggcacagcggccctgggctgcctggtcaggactactcctctctcgact

SEQ ID NO: 459533 - DNA, 396 bp, Homo sapiens; identical to SEQ ID NO: 445818
  misc_feature: HEFZJCU01DO1VL.16.68.G02.1.454.heavy.3.raw

SEQ ID NO: 459534 - DNA, 463 bp, Homo sapiens; identical to SEQ ID NO: 446208
  misc_feature: HEFZJCU01A46G0.19.10.A10.1.454.heavy.3.raw

SEQ ID NO: 459535 - DNA, 502 bp, Homo sapiens; identical to SEQ ID NO: 454914
  misc_feature: HEFZJCU01C1PET.4.58.F03.1.454.heavy.3.raw

SEQ ID NO: 459536 - DNA, 518 bp, Homo sapiens
  misc_feature: HEFZJCU01A5TP2.19.2.A02.1.454.heavy.3.raw
tactctcgtgcacgaccggtgctcgatttagactcatctacagggtctccgaaggctttaacagtcctgtcccaggtgcagctacagcagtggggcgcaggactgttaaagccttcggagaccctgtccctcacctgcgctgtctatggtgggtccttcagaggttactactggagttggatccgccagcccccagggaagggactggagtggattggggaaatcaatcatagtggaagcgccagctacaacccgtccctcaagagtcggctcgacatattagtagacacgcccaagagtcagttctccctgaagctgggctctgtgaccgccgccgacacggctgtctatttctgtgcgagagttggatattgtgctggtggtagctgctacgccgcgtttcagttagactactgggtcagggaaccctggtcaccgtctcctcagcctccaccaagggcccatcggtcttcccctggcgccctgctccaggagcacctccgagagcacagcgcctc

SEQ ID NO: 459537 - DNA, 549 bp, Homo sapiens
  misc_feature: HEFZJCU01EITIV.19.48.E04.1.454.heavy.3.raw
tactctcgtgcacgaccggtgctcgatttagagagcgtcacagagagaagggggtctcagagaggagccttagccctggactccaaggcctttccacttggtgatcagcactgagcacagacgactcaccatggaattggggctgagctgggttttcctcgttggtattttagaaggtgtccagtgtgaggtgcacctggtggagtctgggggaggcttggtccagcctggggggtccctgagactctcctgtacaggctctgggttctcctttagtagttattggatgaactgggcccgccaggctccggggaaggggccggagtgggtggccaacataatgcaagatggaactgagaaaaactatggggactctgtgaagggccgattcaccatctccagagacaaccgtaagaacttactgtttctgcaaatgaacagcctgagagccgaggacacggctgtgtattattgtgcgaaggcaggtggcgtgggacagtgggacgttcgtcgggggaccgaaacggggacccgtacggtccaccggtt

SEQ ID NO: 459538 - DNA, 523 bp, Homo sapiens
  misc_feature: HEFZJCU01B7AHF.53.64.F09.1.454.heavy.3.raw
cgcgtatacacacgaccggtgctcgatttagcgcgtatacaaggggagctctgagagaggagcccagccctgggattttcaggtgttttcatgtggtgatcaggactgaacagagagaactcaccatggagtctgggctgacgtggctttttcttgtggctattttaaaaggtgtccagtgcgacgtgcagctggtggagtcggggggaggcttggtacagccgggggggtccctgagactctcctgtagagtctctggcttcacctttagagtctatgacatgagttgggtccgccaggctccggggaaggggctggagtgggtctcaacgatcagtgatagcggaagtaccacaaactacgccgcctccgtgaagggccgatgcaccgtctccagagacaattcgaaggacacttatatctgcaactcaacagactgacaaccgctgacacggccgtctattactgtgtcaaagaagacggaccgctggacgaggagccagaggaaaatcactactttgta

SEQ ID NO: 459539 - DNA, 521 bp, Homo sapiens
  misc_feature: HEFZJCU01ADV9X.9.34.D01.1.454.heavy.3.raw
tgatacgtctcacgaccggtgctcgatttagatcgtctgtggttgagtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccggggaaccctggtcgccgtctcctcagcctccaccaagggcccatcggtcttccccctggcaccctcctccaagacgcacctctgggggcacagcggccctgggctgcctggtcaaggactacttccagacgtatca

SEQ ID NO: 459540 - DNA, 498 bp, Homo sapiens
  misc_feature: HEFZJCU01DOFTU.13.33.C11.1.454.heavy.3.raw
tcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagaactttcaggacagggtcaccatgaccacggacacgtccatcaacacagcctacatggaactgaggagcctaagatctgacgacacggccgtttattattgtgcaataagattgcaacgatgcttttgatatgtggggaccg

SEQ ID NO: 459541 - DNA, 483 bp, Homo sapiens; identical to SEQ ID NO: 444532
  misc_feature: HEFZJCU01B11O1.47.59.F04.1.454.heavy.3.raw

SEQ ID NO: 459542 - DNA, 506 bp, Homo sapiens
  misc_feature: HEFZJCU01CML81.8.38.D05.1.454.heavy.3.raw
ctcgcgtgtccacgaccggtgctcgatttagtatctgatagttgagctctgggagaggagcccagcactagaagtcggcggtgtttccattcggtgatcagcactgaacacagaggactcaccatggagtttgggctgagctgggttttcctcgttgctcttttaagaggtgtccagtgtcaagtgcaactggtggagtctggggggggctggtccagcctgggaggtccctgagactctcctgtgcaggctctggattcaccttcagtaactacggcgtgcactgggtccgccaggctccaggcaagggcttggagtggctggcagttgttcatctgaaggaagtgttcaatactatacagactccgtgaagggccgattcaccatctccagagacaattccaagaacacgatgtatctgcaaatggacagcctaagagttgaggacacggctgtttattactgtacgaagaggggggatacgagtggcagctccaagtacttac

SEQ ID NO: 459543 - DNA, 518 bp, Homo sapiens
  misc_feature: HEFZJCU01CQ5ZG.10.53.E09.1.454.heavy.3.raw
catagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgttctgcaaatgaacagcctgagagctgaggacacggctgtgtattactgttcgtttggttctgtactcgtcgggggaataccttcagcactggggccgac

SEQ ID NO: 459544 - DNA, 518 bp, Homo sapiens; identical to SEQ ID NO: 453349
  misc_feature: HEFZJCU01DAG0J.16.35.D02.1.454.heavy.3.raw

SEQ ID NO: 459545 - DNA, 510 bp, Homo sapiens
  misc_feature: HEFZJCU01BWSI8.51.5.A05.1.454.heavy.3.raw
cgatcgtatacacgaccggtgctcgatttagatagatagacagggggtgctttctgagagtcatggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaaggggctggagtggatagggcgaatcaatcatagtggagacaccgactacaacccgtccctcatgagtcgagtcaccatgtcagtggactcgtccaagagtgagttctccctgaggctgacgtctttaagtgtcgctgatacggtgtctatttctgtgcgagctgcccggtcctgcacctcgtgtggccccatttggtttaccggcacacaaaatcagggcaagtcctacgacggtctggacg

SEQ ID NO: 459546 - DNA, 493 bp, Homo sapiens
  misc_feature: HEFZJCU01C2AI3.47.85.H08.1.454.heavy.3.raw
  modified_base (491)..(491): a, c, t, g, unknown or other
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcgggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattccaccatcctccagagacaattcccagaacacggtctatctgcacctgaccagcctgagaactgacgacacgtctctctaactctgtgcgagagagttgaacgngt

SEQ ID NO: 459547 - DNA, 507 bp, Homo sapiens
  misc_feature: HEFZJCU01AKEQ0.18.39.D06.1.454.heavy.3.raw
tacgagtatgcacgaccggtgctcgatttagtgacatctcgcagttctggggctgaggtgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagatggtcgttgtttgttttggccggtgaactactgggccagggcaccctggtcaccgtctcctcagcttccaccaagggcccatcggtcttcccctggcgcctgctccagagcacctctgggggcacagcggccctgggctgcctggtcaggactactcccatac

SEQ ID NO: 459548 - DNA, 491 bp, Homo sapiens
  misc_feature: HEFZJCU01DP6E3.11.26.C04.1.454.heavy.3.raw
cgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcgccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttccgtatctctcg

SEQ ID NO: 459549 - DNA, 483 bp, Homo sapiens
  misc_feature: HEFZJCU01C57ZH.51.6.A06.1.454.heavy.3.raw
  modified_base (441)..(441): a, c, t, g, unknown or other
  modified_base (452)..(452): a, c, t, g, unknown or other
  modified_base (468)..(468): a, c, t, g, unknown or other
cgatcgtatacacgaccggtgctcgatttagatctactgacaggggagctctgggagacgagcccagcactggaagtcgccggtgtttccattcggtgatcatcactgaacacagaggactcaccatggagtttgggctgagcgtggtttcgtcgtaggcgtctttaagtaggtgtccagtgtcaggtgcagctggtgcagtctgggggaggcgtggtccagcctgggaggtccctgagactctcctgtgaagcctctggattcagcttcagtacgtatggtttgcgctgggtccgccaggctccaggcaagggctgcagtgggtggcatctatatcatatgaaggaagcaataatactacgcaagactccgtgaagggccgattcaccatctccagagacaatcccaagaacacactttatctgcaatgaacaccctganacttgaggacncggctgtctattattntgcgagaggagatcg

SEQ ID NO: 459550 - DNA, 505 bp, Homo sapiens
  misc_feature: HEFZJCU01BDMM2.3.85.H08.1.454.heavy.3.raw
agacgcactccacgaccggtgctcgatttagtatcactcagtcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctggtggagtctgggggaggcttggtacagcctggggggtccctgagactctcctgtgcagcctctggattcacctttagtaattatgccatgagctgggtccgccaggctccagggaaggggctggagtgggtctcagctattagtgatcgtggtggtaacacatactacgcagactccgtgaagggccgcttcaccatctccagagacaattccaagaacacgctgcatctgcaaatgaacagcctgagagccgaggacacggccctttatactgtgcgaaaccaatcacgtataactggaactacgta

SEQ ID NO: 459551 - DNA, 513 bp, Homo sapiens
  misc_feature: HEFZJCU01B6VP5.16.71.G05.1.454.heavy.3.raw
tgtactactccacgaccggtgctcgatttagtgtcgtcgcaagagagaggggcccagccctgggattttcaggtgttttcatttggtgatcaggactgaacagagagaactcaccatggagtctgggctgagctggctttttcttgtggctattttaaaaggtgtccagtgtgaggtgcagctgttggagtctgggggaggcttggcacagcctggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgacctactggggccaac

SEQ ID NO: 459552 - DNA, 509 bp, Homo sapiens
  misc_feature: HEFZJCU01EAAB6.49.86.H09.1.454.heavy.3.raw
agtcgagagacacgaccggtgctcgatttagtgctatagacttgggtttggggacccaacaaccacatccctcctcagaagcccccagagcacaacgcctcaccatggactggacctggaggatcctctttttggtggcagcagccacaggtgcccactcccaggtccaacttgtgcagtctggggctgagttgaagaagcctggggcctcagtgaaggtttcctgcacggtttctggataccccctcagcagtcatgctatgcattgggtgcgccaggcccccggacaaaggtttgagtggatgggatggatcaccgctggcaatggtgacacaaatattcacaaagttccagggcagagtcaccatttacagggacacatctgcgagttcaggctacatggaactgagcggcctgagatatgaggacacggctatttattactgtgcgagagggaaatgggatattgtgtcagctccaggtgcccagcccggccccctactttgtac

SEQ ID NO: 459553 - DNA, 529 bp, Homo sapiens; identical to SEQ ID NO: 455756
  misc_feature: HEFZJCU01CT3AY.7.70.G04.1.454.heavy.3.raw

SEQ ID NO: 459554 - DNA, 530 bp, Homo sapiens
  misc_feature: HEFZJCU01AGV3Z.48.76.G10.1.454.heavy.3.raw
agtatacatacacgaccggtgctcgatttagtcactcatacagggggggagaggagccccagccgtgagattcccaggagttttcacttggtgatcagccctgaaaacagaccaccaaccatggagtttgggcttaactgggttttccttgttgctattttaaaaggtgcccaatgtgaggtgcagctggtggagtctgggggagccttggtacagccaggggggtccctgagactctcctgttcaacttctggattcacctttggtgattatattatgagttgggtccgccaggcgccagggaaggcactggagtgggttgctttcattagtcccaaactttctggtgggacagcatactacgccccgccagaatatgccgcgtctgtgcaaggcagattcaccatgtcaagagatgaatccaaaggtatcgcctatctgcaaatgaacagcctgaaaaccgaggacacagccgtctattactgtactagagcctattttgtactatctggtgtattcacctttcccgt

SEQ ID NO: 459555 - DNA, 518 bp, Homo sapiens; identical to SEQ ID NO: 444718
  misc_feature: HEFZJCU01DSQOV.9.34.D01.1.454.heavy.3.raw

SEQ ID NO: 459556 - DNA, 547 bp, Homo sapiens
  misc_feature: HEFZJCU01C5CQS.40.57.F02.1.454.heavy.3.raw
tctagcgactcacgaccggtgctcgatttagctcgatatagttgggtttggggtctgagagaggagcccagccctgggactttcaggtgttttcatttggtgatcaggactgaacagagagacctcaccatggactttgggctgaggtggctttttcttgtggctcttttaaaaggtgtccagtgtgaggtgcagttattggagtcggggggaggcttaatacagccgggggggtccctgagactcgcctgtacagcctctggactcacctttagaaatgatgccttgagctgggtccgccaggctgcagggaaggggctggaatgggtctctattattagtggtaggacagatagtcgaaactacgctgactccgtgaagggccgcttcaccatctccagagacgtttccaacaacacgatctttctggagatgaatagcctgagagccgaggacacggccaaatattaactgtgcgaaaagaaccctctattgtagtggtggaagttgtaactactactttgattcctggggtccagggaacccg

SEQ ID NO: 459557 - DNA, 512 bp, Homo sapiens
  misc_feature: HEFZJCU01AWXV1.49.81.H04.1.454.heavy.3.raw
agtcgagagacacgaccggtgctcgatttagtagtgtagattcgcggggagctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggccgattcaccatctccagagacaattccaagaacacgctatatttgcacatgaacagcctgagagctgaggacacggctatttattactgtgcgaacttaatcacggaggacaaggggtcacccccgtcc

SEQ ID NO: 459558 - DNA, 518 bp, Homo sapiens
  misc_feature: HEFZJCU01C6CDG.47.64.F09.1.454.heavy.3.raw
agctcacgtacacgaccggtgctcgatttagcgcgtatacaagggggctttctgagagtcatggatctcatgtgcaagaaaatgaagcacctgtggttcttcctcctgctggtggcggctcccagatgggtcctgtcccagctgcaactgcaggagtcgggcccaggactggtgaagccttcggagaccctgtccctcacttgcattgtctctggtggctccatcaccagtttttaattattggtgggctggatccgccagcccccagggaagggctggaatggattgggagtatattttataatggggacactctttacaacccatccctcaagagtcgagtttccatatccgcagacacgtccgagaatcacttctccctgaaactgagctctgtgaccgccgcagacacggctgtttattactgttcgagacatgccgaccgagagcattatcggcagtacggttttgatatttggggccaagggacaaggtcaccgtctccgcagcctcaaccg

SEQ ID NO: 459559 - DNA, 499 bp, Homo sapiens
  misc_feature: HEFZJCU01DYUPN.53.1.A01.1.454.heavy.3.raw
cgcgtatacacacgaccggtgctcgatttagacgtctcatcagggggcatcacataacaaccagattcctcctctaaagaagcccctgggagcacagctcatcaccatggactggacctggaggttcctctttgtggtggcagcagctaccggtgtccagtcccaggtccacctggtgcaatccgggactgaggtgaagaagcctgggtcctcggtgaaggtctcctgcaaggcctctggagacaccttcaacagttatggtatcagttgggtgcgacaggcccctggacaagggcttgagtggatgggaaggatcatcccaatccttggtattacaaaaaatgcacagaggtttcagggcagagtcctgttaaccgcggacaaatccactaccacagtctacatggagctgagcagcctgagatctgaagacacggccctgtactattgtgcgagagaaatgtacttctatgacagtactaatcaatatgcttttgat

SEQ ID NO: 459560 - DNA, 492 bp, Homo sapiens
  misc_feature: HEFZJCU01DK0EH.47.85.H08.1.454.heavy.3.raw
agctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctgaggggccgattcaccatctccagagacaattcccagaacacggtctatctgcacctgaccagcctgagaactgacgacacgtctctctactactgtgcgagagagttgacgagtc

SEQ ID NO: 459561 - DNA, 396 bp, Homo sapiens; identical to SEQ ID NO: 446990
  misc_feature: HEFZJCU01DTDJL.51.70.G04.1.454.heavy.3.raw

SEQ ID NO: 459562 - DNA, 529 bp, Homo sapiens
  misc_feature: HEFZJCU01BOCXP.17.34.D01.1.454.heavy.3.raw
cgtagactagcacgaccggtgctcgatttagatcgtctgtgttgggtttggggacaaaacaaccagattcctcctctaaagaagcccctgggagcacagctcatcaccatggactggacctggaggttcctctttgtggtggcagcagctacaggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcggacaaattaacgaacacagttaatctggagctgaacagcctgtcatctgaggacacgggcttctacttctgtgcgaggagtaattactataacactgctccttttacacctcccttgacttctgggccatcggaaccccggtcaccgt

SEQ ID NO: 459563 - DNA, 520 bp, Homo sapiens
  misc_feature: HEFZJCU01DC3VU.18.33.C11.1.454.heavy.3.raw
tacgagtatgcacgaccggtgctcgatttagagtgagctcgttgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaaggggctggagtggctcgcacttatttacagtggcggcactacatactacacagacttcgcgaggggccgattcaccatctccagagacgattccaagaacacgttgtatcttcaaatgaacagcctgacagtcgacgacacggccatgtatttttgtgcgagcgacccggggctcctcaatggctttcattactggggccagggaaccctagtcaccgtcgccgcagcctccaccaagggcccatcggtcttcccctggcgccctgctccaggagcacctccgagacggccctgggctgcctggtcaaggacta

SEQ ID NO: 459564 - DNA, 516 bp, Homo sapiens
  misc_feature: HEFZJCU01AMIH3.12.55.E11.1.454.heavy.3.raw
atacgacgtacacgaccggtgctcgatttagcactcgcacgttgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctcgtggggccgtggcacctggtcactgtctcctcggcttccaccaagggcccatcggtcttcccctggccgccctgctccaggagcacctcgtgggggcacagcggcccg

SEQ ID NO: 459565 - DNA, 491 bp, Homo sapiens
  misc_feature: HEFZJCU01DVWVZ.3.34.D01.1.454.heavy.3.raw
agacgcactccacgaccggtgctcgatttagatcgtctgtgttgggtttggggggtccctgagactcgcctgcgcaccttctggattcacctttagtacatatgtcatgacctgggtacgccaggctccagggaaggggctggagtgggtcgcaagtataaacggtcgtgctgataagacagcctacgcagacgccgtgaaggggcgggtgaccatctccagagacaattacaagaacatgctgtatctgcgattgaacaacgtcagagccgacgacacggcccactattattgtgcgagagagagaacattaaatttggcgggctactacgagaacggattgggcgcctggggccaagggaccacggtcatcgtctccgcagcctccaccaagggcccatcggtcttcccctggcaccctcctccaagagcacctctgggggcacagcggccctgggctgcctggtcaaggactatttccgagtgcgtct

SEQ ID NO: 459566 - DNA, 476 bp, Homo sapiens; identical to SEQ ID NO: 452095
  misc_feature: HEFZJCU01C7LDQ.16.10.A10.1.454.heavy.3.raw

SEQ ID NO: 459567 - DNA, 515 bp, Homo sapiens; identical to SEQ ID NO: 451390
  misc_feature: HEFZJCU01EF2YI.16.2.A02.1.454.heavy.3.raw

SEQ ID NO: 459568 - DNA, 508 bp, Homo sapiens; identical to SEQ ID NO: 445911
  misc_feature: HEFZJCU01B9BZ9.12.78.H01.1.454.heavy.3.raw

SEQ ID NO: 459569 - DNA, 518 bp, Homo sapiens
  misc_feature: HEFZJCU01B8UBU.12.40.D07.1.454.heavy.3.raw
  modified_base (486)..(486): a, c, t, g, unknown or other
  modified_base (493)..(493): a, c, t, g, unknown or other
atacgacgtacacgaccggtgctcgatttagtgatagagcgtaacaacagagggctcaccatggagtttgggctgagcgtggtttcgtcgttagctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcggagagagacacacgaaccctactggccaatactatggggcttgttctggggccaggggaccctggtcatcgtctcccngcctccnccaaggccatcggtctcccctgccg

SEQ ID NO: 459570 - DNA, 514 bp, Homo sapiens
  misc_feature: HEFZJCU01DD8L5.3.20.B09.1.454.heavy.3.raw
agacgcactccacgaccggtgctcgatttagtgtagtgtgaagggacagggtctccgaaggcttcacctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtgggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctgggccaagggacaatggtcaccgtctcttcagcctccaccaagggcccatcggtcttcccctggcaccctcctccaagagcacctctgggggcacagcggcccg

SEQ ID NO: 459571 - DNA, 527 bp, Homo sapiens
  misc_feature: HEFZJCU01CH310.7.78.H01.1.454.heavy.3.raw
cgtgtctctacacgaccggtgctcgatttagtgtgagtagtttgggtttggggacccaacaaccacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagcctttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgtttatttttgtacgagagcgtcgtctgtcagtggaattgactactgggccagggaaccctggtcaccgtctcctcagcctccacc

SEQ ID NO: 459572 - DNA, 462 bp, Homo sapiens
  misc_feature: HEFZJCU01A0DLK.11.10.A10.1.454.heavy.3.raw
cgagagataccacgaccggtgctcgatttagcgtcgatctcaggggtccgggagatcatgagggtgtccttgggttttggggggaagaggaagactgacggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccacggtcaccgtctcctcagcctccaccaagggcccatcggtcttccccctggcgccctgctccaggagcacctccgagagcacagcggccctgggctgcctggtcaaggactacttccgtatctctcg

SEQ ID NO: 459573 - DNA, 477 bp, Homo sapiens; identical to SEQ ID NO: 444659
  misc_feature: HEFZJCU01BOMMI.16.10.A10.1.454.heavy.3.raw

SEQ ID NO: 459574 - DNA, 414 bp, Homo sapiens
  misc_feature: HEFZJCU01ECMEC.13.25.C03.1.454.heavy.3.raw
tcacgtactacacgaccggtgctcgatttagtagtgtagatttgggtttgggtgcgccaggcccctggacaaggccttgagtggatgggatggatgaaccctgagagtggtaacacaggctatgcacagaagttccagggcagactcaccatgacctgggacacctccataagcacagcctacatggagctggagcagcctgcgatctgaggacacggccatgtattactgtgcgagatttcaaaggaattacctgccgtacatggacgtctggggcgaggggaccacggtcaccgtctcctcagcctccaccaagggcccatcggtcttccccctggcgccctgctccaggagcacctccgagagcacagcggcctgggctgcctggtcaaggactacttcctagtacgtcga

SEQ ID NO: 459575 - DNA, 489 bp, Homo sapiens
  misc_feature: HEFZJCU01EII7A.48.39.D06.1.454.heavy.3.raw
  modified_base (465)..(465): a, c, t, g, unknown or other
agtatacatacacgaccggtgctcgatttagtgacatctcgcagttctttggggatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaagggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggcccgagcgcagtggcttttgntgctttgatatgtgggcaagggac

SEQ ID NO: 459576 - DNA, 379 bp, Homo sapiens; identical to SEQ ID NO: 444450
  misc_feature: HEFZJCU01DM8XC.47.77.G11.1.454.heavy.3.raw

SEQ ID NO: 459577 - DNA, 530 bp, Homo sapiens
  misc_feature: HEFZJCU01EH64U.4.59.F04.1.454.heavy.3.raw
agcactgtagcacgaccggtgctcgatttagtacacacacttagggattgggggggaaatactttctgagagtcctggacctcctgtgcaagaacatgaaacatctgtggttcttccttctcctggaggcagctcccagatgggtcctgtcccaggtgcagctgcaggagtcgggcccaggactggtgaagccttcggagaccctgtccctcacctgcactgtctctggtgactccataagtagtttcttctggagctggatccggcagcccccagggaagggactggagtggattggccatatctcttacagtgggagcaccaactacaacccctccctcaagagtcgtgtcaccgtgtcaatagacacgtccaagaaccagttctccctgaggctgagctctgtgaccgccgcggacacggccgtgtatttctgtgcgagatcttcgattttggagtggtaaccccttggctacgtgggccagggaaccctggtcaccgtctcttcagcctccaccaagggccctacg

SEQ ID NO: 459578 - DNA, 499 bp, Homo sapiens
  misc_feature: HEFZJCU01C73UC.13.12.B01.1.454.heavy.3.raw
tcacgtactacacgaccggtgctcgatttagtagtgtagattcgcaggcgtggtccagcctgggaggtccctgagactctcctgtgcagcctctggattcaccttcagttcctttgctatgcattgggtccgccaggctccagggaaggggctggagtggttggcagtcatttcagatgatggcaatgataaatattacgcacgctccgtgaagggccgattcgccatctccagagacaattccaggaacacgctgtacctggagatggacggcctgagacctgacgacacggcaattattactgtgcgagggtttatgtgttggaacgtggtacaccggaaaactggttcgacccctggggccagggaaccctggtcgtcgtctcgtctgcctccaccaagggcccatcggtcttcccctggcaccctcctccaagagcacctctgggggcacagcggccctgggctgcctggtcaaggactacttccgtactagacg

SEQ ID NO: 459579 - DNA, 513 bp, Homo sapiens
  misc_feature: HEFZJCU01DWBCO.22.36.D03.1.454.heavy.3.raw
acatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccaggggaaggggttgcagtgggtctcggggattgggaagtgatgggtgccacacactacgcagactccgtgaggggccgcttcatcatctccagagacgattccgaaaacacagtgaatctgcaaatgtacagcctcagcgccgaggacacggccgtctacttctgtgcgaaagacctctattttgggccgcggccgtaccg

SEQ ID NO: 459580 - DNA, 508 bp, Homo sapiens
  misc_feature: HEFZJCU01CROQ0.4.33.C11.1.454.heavy.3.raw
agcactgtagcacgaccggtgctcgatttagagtgagctcgttgggtttggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagctggtggagtctgggggaggcttggtccagccagggcggtccctgagactctcctgtacagcgtctggattcaactttcgtgattatgccatgaactgggtccgccaggctccagggaaggggctggagtgggtaggtttcattagagccatggcttatgctgggacaacagaatacgccgcgtctgtgaaaggcagattcatcatctcaagagatgattccaacggcatcgctatctgcagatgaacagcctgaagaccgaggacacagccgtctattactgtgttagggagttttacgatttttggt

SEQ ID NO: 459581 - DNA, 511 bp, Homo sapiens; identical to SEQ ID NO: 446675
  misc_feature: HEFZJCU01DZ37Z.4.23.C01.1.454.heavy.3.raw

SEQ ID NO: 459582 - DNA, 506 bp, Homo sapiens; identical to SEQ ID NO: 445864
  misc_feature: HEFZJCU01CA2VX.13.37.D04.1.454.heavy.3.raw

SEQ ID NO: 459583 - DNA, 508 bp, Homo sapiens
  misc_feature: HEFZJCU01BB281.49.81.H04.1.454.heavy.3.raw
agtcgagagacacgaccggtgctcgatttagtagtgtagattcgcggggagctctgggagaggaacccagcactagaagtcggcggtgtttccattcggtgatcaacactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgtagtctctgggttcaccttcagggtctatgacatgcactgggtccgccaggctccaggcgaggggctggagtgggtggcagttatatcgaatgatggaagtaagaagtactatgcagactccgtgaagggcgattcaccatctccagagacaattccaagaacacgctatatttgcacatgaacagcctgagagctgaggacacggctatttattactgtgcgaacttaatcacggagacaagggtgaccccgtccg

SEQ ID NO: 459584 - DNA, 517 bp, Homo sapiens
  misc_feature: HEFZJCU01C40WM.12.40.D07.1.454.heavy.3.raw
atacgacgtacacgaccggtgctcgatttagtgatagagcgtaacacagagggctcaccatggagtttgggctgagcgtgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccatactatggggcttgttctggggccaggggccctggtcatcgtctccccagcctccaccaaggcccatcggtcttcccctggcg

SEQ ID NO: 459585 - DNA, 495 bp, Homo sapiens; identical to SEQ ID NO: 455439
  misc_feature: HEFZJCU01AFRJJ.51.25.C03.1.454.heavy.3.raw

SEQ ID NO: 459586 - DNA, 499 bp, Homo sapiens; identical to SEQ ID NO: 450187
  misc_feature: HEFZJCU01BS9AN.47.38.D05.1.454.heavy.3.raw

SEQ ID NO: 459587 - DNA, 519 bp, Homo sapiens; identical to SEQ ID NO: 446650
  misc_feature: HEFZJCU01CHZCK.13.76.G10.1.454.heavy.3.raw

SEQ ID NO: 459588 - DNA, 506 bp, Homo sapiens; identical to SEQ ID NO: 446520
  misc_feature: HEFZJCU01CQKDW.10.38.D05.1.454.heavy.3.raw

SEQ ID NO: 459589 - DNA, 518 bp, Homo sapiens; identical to SEQ ID NO: 444718
  misc_feature: HEFZJCU01DTF93.9.34.D01.1.454.heavy.3.raw

SEQ ID NO: 459590 - DNA, 514 bp, Homo sapiens
  misc_feature: HEFZJCU01B7TNW.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaactcctactacggtctggacgtctggggccagggacc

SEQ ID NO: 459591 - DNA, 504 bp, Homo sapiens
  misc_feature: HEFZJCU01EY14U.53.33.C11.1.454.heavy.3.raw
cgcgtatacacacgaccggtgctcgatttagagtgagctcgttgggtttggggggaagaggaagactgacggtcctcccaggagttcaggtgctgggcaccgtgggcatgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgaccctggggccagggaaccctggtcaccgtctcctcagcttccaccaagggcccatcggtcttcccctggcgccctcgctcc

SEQ ID NO: 459592 - DNA, 528 bp, Homo sapiens
  misc_feature: HEFZJCU01D3IKK.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagctgggtttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaagggcctggagtggatctcacttatttatagtggtggtaccacatactacacagactccgtgaagggccgattcaccatctcagaagacaattccaggaacacattgtatcttcaaatgaataacctgagagccggaggacacggccatgtattactgtgtgggcatttactgaccctggggccgggaacctggtcaccgtctccccaccctccaaccg

SEQ ID NO: 459593 - DNA, 527 bp, Homo sapiens; identical to SEQ ID NO: 455909
  misc_feature: HEFZJCU01DZLCA.11.25.C03.1.454.heavy.3.raw

SEQ ID NO: 459594 - DNA, 504 bp, Homo sapiens
  misc_feature: HEFZJCU01BD263.48.74.G08.1.454.heavy.3.raw
agtatacatacacgaccggtgctcgatttagtagctctatcaggggctgggagaggagccccagccctgagattcccaggtgtttccattcagtgatcagcactgaacacagaggactcaccatggagttgggactgagctggattttccttttggctcttttaacaggtgtccagtgtgaagtgcagctggtggagtctgggggaggcttggtacagcccggcaggtccctgagactctcctgtgcagcctctggattcatctttggtgattatgccatgcactgggtccggcgaattccagggaagggcctggagtgggtctcaggtattagttgggatggtgacagtataggctatgcggactctgtgaggggccgattcaccatcaccagggaaaacgccaataactccctgtgtctacaaatgaacaatctgagacctgaagacacggccttgtattttgtgtaaagatattctcgacaattatggtcatcgtgggtat

SEQ ID NO: 459595 - DNA, 500 bp, Homo sapiens
  misc_feature: HEFZJCU01EYRNO.11.71.G05.1.454.heavy.3.raw
cgagagataccacgaccggtgctcgatttagtgtcgtcgcaagagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttatttcatatgatggaaatagtgacttctattcagactccgtgaagggccgattcaccgtctccagagacaattccaggcacacgctgtatctgcaaatgaacagcctgagagctgaggacacggctgtgtattactgtgacgaaagatttctatagaggtgacgtacgggggcgttcg

SEQ ID NO: 459596 - DNA, 392 bp, Homo sapiens
  misc_feature: HEFZJCU01CV74J.16.24.C02.1.454.heavy.3.raw
tgtactactccacgaccggtgctcgatttagtacagatcgttagggaaggggctggagtgggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaagggcccatcggtcttccccctggcgccctgctccaggagcgacctccgagagcacagcggccctgggctgcctggtcaaggactacttccgagtagtacaa

SEQ ID NO: 459597 - DNA, 502 bp, Homo sapiens
  misc_feature: HEFZJCU01CCJ7A.14.78.H01.1.454.heavy.3.raw
cgtctagtaccacgaccggtgctcgatttagtgtgagtagtttgggtttgggagctctgggagaagagccccagccccagagttcccaggagtttccattcggtgatcagcactgaacacagaggactcaccatggagtttgggctgagctgggtcttccttgttgctattataaaaggtgtccagtgtcaagtgcagttggtggagtctgggggaggcttggtcaagcctggagggtccctgagactctcctgtgcagcctctggattcaccttcagtgactactacatgacctggatccgccaggcgccagggaagggctggaatggattgcatacattcactatagtggaaatgcagtgtcctacgcagactctctgaagggccgattcaccgtctccagggacaacgccaagaactgctgtatctgcaaatcgacggcctgagagtcgaggacacggccatgtattactgtgcgagagtgtggttcggtcagtgtttt

SEQ ID NO: 459598 - DNA, 524 bp, Homo sapiens
  misc_feature: HEFZJCU01D0TKB.53.10.A10.1.454.heavy.3.raw
cgcgtatacacacgaccggtgctcgatttagcgtcgatctcagggtcttcgtggctcacgtccaccaccacgcatgtgacctcaggggtccctgagactctcctgtgcagcctctggatttaacttcagaacctatgacatgaactggatccgccaggctccagggaagggactggagtgggtctcatccattagtcctggtggtacttctatatactactcagattcagtgaggggacgattcaccatctccagagacaacgccgcgagttcagtgtttctgcagatgcacaacttgagagtcgaagacacggcggtctatttctgcgcgaggaaaagtcgcattccagagcctgtacgcccgccttggtctcgtcagttggtcaatccgccctccagggggacctttggggtttcgacccctggggccagggaaccctggtcaccgtctcctcagcctccaccaaggcccatcggtcttcccctggccaccctcctccaagagcacctctgggggcacagcc

SEQ ID NO: 459599 - DNA, 490 bp, Homo sapiens
  misc_feature: HEFZJCU01DSW9Z.49.34.D01.1.454.heavy.3.raw
agtcgagagacacgaccggtgctcgatttagatcgtctgtgttgggtttgggaggtccctgagactctcctgtgtagtctctggattcaccttcagggtctatgacatgcactgggtccgccaggctccaggcaaggggctggagtgggtggcagttatatcaaatgatgcaagtaacaaatactatgtagactccgtgaagggccgattcaccatctccagagacaattccaagaatacgctgtatctgcacatgaacagcctgagagccgaagacacgggtgtttattactgtgcgaacttaattacggaggacaacggtaacccccgtccgcacggtacggacgtctggggccaagggaccacggtcaccgtctcctcagcctccaccaaggcccatcggtcttcccctggcaccctcctccaagagcacctctgggggcacagcggccctgggctgcctggtcaaggactacttcctctctcgact

SEQ ID NO: 459600 - DNA, 490 bp, Homo sapiens; identical to SEQ ID NO: 444500
  misc_feature: HEFZJCU01CO96T.19.53.E09.1.454.heavy.3.raw

SEQ ID NO: 459601 - DNA, 502 bp, Homo sapiens
  misc_feature: HEFZJCU01DB17I.53.33.C11.1.454.heavy.3.raw
cgcgtatacacacgaccggtgctcgatttagagtgagctcgttgggtttggggggaagaggaagactgacggtcctcccaggagttcaggtgctgggcaccgtgggcatgggggaggcgtggtccagcctgggaggtccctgaaactctcctgtgcagcctctggattcgtctcaagtgtctaccctttgcactgggtccaccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctgaagacacggctgtgtattactgtgcgagtgagatgtcttactatgatgccagtggtttggtaccgttcgacccctggggccgagggaaccctggtcaccgtctcctcagcttccaccaaggcccatcggtcttcccctgcgcctgctcc

SEQ ID NO: 459602 - DNA, 504 bp, Homo sapiens; identical to SEQ ID NO: 445648
  misc_feature: HEFZJCU01EK98N.17.25.C03.1.454.heavy.3.raw

SEQ ID NO: 459603 - DNA, 400 bp, Homo sapiens; identical to SEQ ID NO: 444452
  misc_feature: HEFZJCU01BIZ0Q.47.24.C02.1.454.heavy.3.raw

SEQ ID NO: 459604 - DNA, 503 bp, Homo sapiens; identical to SEQ ID NO: 444557
  misc_feature: HEFZJCU01BPO9F.9.33.C11.1.454.heavy.3.raw

SEQ ID NO: 459605 - DNA, 518 bp, Homo sapiens; identical to SEQ ID NO: 444718
  misc_feature: HEFZJCU01A1PXP.9.34.D01.1.454.heavy.3.raw

SEQ ID NO: 459606 - DNA, 519 bp, Homo sapiens
  misc_feature: HEFZJCU01BHIKP.9.63.F08.1.454.heavy.3.raw
tgatacgtctcacgaccggtgctcgatttagcgatcgtataagggttgatccagcccagccacaggagcccactcccaggtgcagttgatgcaatctgggcctgacgtgaggaagcctggggcctcagtgcaagtctcctgccaggcctctggatatacataccgcgaccactacatacagtgggtgcgcctggcccctggacgaggccttgagtggctgggctggatcaacccttacaccggtcgcccaaactatgcagcgtcttttcggaacagggtcaccctgacctgggacgcgtcccgcaatacagcctccatggaattgaccacactgaaatctgacgacacggccgtctactattgtgcgagggtcaatagtcttaccataaacggtgcccggacagatgatttttggatgtctggggccaaggtacagcggtcaccgtcgcctcagcctccaccaagggcccatcggtcttcccctggcaccctcctccaagagcacctctggggcacacg

SEQ ID NO: 459607 - DNA, 506 bp, Homo sapiens; identical to SEQ ID NO: 444696
  misc_feature: HEFZJCU01DJIYP.16.34.D01.1.454.heavy.3.raw

SEQ ID NO: 459608 - DNA, 499 bp, Homo sapiens
  misc_feature: HEFZJCU01D47PO.12.14.B03.1.454.heavy.3.raw
atacgacgtacacgaccggtgctcgatttagtgtgagtagttccgcgggggggggaggcttggttcggcctggcgggtccctgagactctcctgcgcaacctctggattcctttttgaggattttgccatgcactgggtccggcaagctccggggaggggcctggagtgggtctcaacaattacttggaatagtgctaccatagcctacacagactccgtgaagggccgattcatcacttctagagacaacgccgagaactccctgtatctgcagatgaacagtctgagacctgaggacacggccctgtatttctgttcaaaaggggctctggttcagggatggggctttgactcctgggcccagggaaccctggtcgcggtctcctcagcctccaccaagggcccatcggtcttccccctggcaccctcctccaagagcacctctgggggcacagcggccctgggctgcctggtcaaggactacttcctacgtcgtat

SEQ ID NO: 459609 - DNA, 493 bp, Homo sapiens
  misc_feature: HEFZJCU01BTFB0.19.53.E09.1.454.heavy.3.raw
tactctcgtgcacgaccggtgctcgatttagagagagtgtgttgggtctgggggaggcttggtacagcctggcaggtccctgagactctcctgtgcagcctctggattcacctttgatgattatgccatgcactgggtccggcaagctccagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactactggggccagggaaccctggtcaccgtctcctcagcctccaccaagggcccatcggtcttcccctggcgccctgctccaggagcacctccgagagcacagcggcccgtgggcctgcctggtcaaggactacttcccacgagagta

SEQ ID NO: 459610 - DNA, 525 bp, Homo sapiens; identical to SEQ ID NO: 447753
  misc_feature: HEFZJCU01BL7YC.16.27.C05.1.454.heavy.3.raw

SEQ ID NO: 459611 - DNA, 503 bp, Homo sapiens
  misc_feature: HEFZJCU01B2TZJ.13.76.G10.1.454.heavy.3.raw
tcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgaggggccgattcaccatctccagagacaattccaagaacacgctgtttcttcaaatgaacagcctgagagccgatgacacggccgtgtattactgtgcgagagatggggcccacgaacgttactacgctatggacgtc

SEQ ID NO: 459612 - DNA, 519 bp, Homo sapiens; identical to SEQ ID NO: 444867
  misc_feature: HEFZJCU01CUBGU.9.34.D01.1.454.heavy.3.raw

SEQ ID NO: 459613 - DNA, 396 bp, Homo sapiens; identical to SEQ ID NO: 444469
  misc_feature: HEFZJCU01D4Z0W.47.46.E02.1.454.heavy.3.raw

SEQ ID NO: 459614 - DNA, 537 bp, Homo sapiens
  misc_feature: HEFZJCU01D9JH6.22.38.D05.1.454.heavy.3.raw
acatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgacccctggggcccgggaaccctggtcaccgtctcctcagcctccaccaacgggcccactcggtcttccccctc

SEQ ID NO: 459615 - DNA, 517 bp, Homo sapiens
  misc_feature: HEFZJCU01DKHEG.9.34.D01.1.454.heavy.3.raw
  modified_base (515)..(515): a, c, t, g, unknown or other
tgatacgtctcacgaccggtgctcgatttagatcgtctgtgttgggtttgggggaggcttggtccagcctggggagtccctgcgactctcctgtgtggcctctggattcacctttgagacctatgccttgacctgggtccgccaggctccaggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattactggggccgggaaccctggtcgccgtctcctcagcctccaccaagggcccatcggtcttcccctggcaccctcctccaagagcacctctgggggcacagcggccctgggctgcctggtcaaggactacttccagacgtanca

SEQ ID NO: 459616 - DNA, 391 bp, Homo sapiens
  misc_feature: HEFZJCU01BHSZL.16.70.G04.1.454.heavy.3.raw
tgtactactccacgaccggtgctcgatttagtgtagtgtgaagggaaggggctggagtggatcgggaatatctattatagtgggagcacctactacaacccgtccctcaagagtcgagtcgccatatccgtagacacgtccaagaaccacttctccctgaaactgagctctgtgaccgccgcagacacggctgtctattactgtgcgagacagagttacgacggtggttactccggtctctttgacaactggggccagggaaccctggtcaccgtctcctcagcctccaccaagggcccatcggtcttccccctggcaccctcctccaagagcacctctgggggcacagcggccctgggctgcctggtcaaggactacttcgagtagtaca

SEQ ID NO: 459617 - DNA, 525 bp, Homo sapiens
  misc_feature: HEFZJCU01B6JZ3.13.63.F08.1.454.heavy.3.raw
tcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggacggtttttgggggcgcggactcctcttgagatctggggccagggggacaagtggtcaccgtctcttcagt

SEQ ID NO: 459618 - DNA, 497 bp, Homo sapiens
  misc_feature: HEFZJCU01CY5OZ.48.77.G11.1.454.heavy.3.raw
agtatacatacacgaccggtgctcgatttagctagtcactcaagggaaaggggtctgggagacgagcccagcactggaagtcgccggtgtttccattcggtgatcagcactgaacacagaggactcaccatggagtttgggctgacctgggttttcctcgttgctcttttaagaggtgtccagtgtcaggtgcagctggtggagtctgggggaggcgtggtccagcctgggaggtccctgagactctcttgtgcagcctctggattcattttcagtgactatggtatgcactgggtccgccaggctccaggcaaggggctggagtgggtggcagtcataccttctgctggaaggaatatctactacgcgggctccgtgaagggccgattcaccatctccagagacaattccaacaagacactgtatctgcaaatgaacagcctgagggctgaagacacggctgtgtattactgtgcgagaggctatcactatggttc

SEQ ID NO: 459619 - DNA, 524 bp, Homo sapiens
  misc_feature: HEFZJCU01CGD32.12.40.D07.1.454.heavy.3.raw
atacgacgtacacgaccggtgctcgatttagtgatagagcgtaacaacagagggctcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatgggggcttgttctggggccaggggaccctggtcatcgtctccccagcctccaccaacgggcccatcggtcttccccctcggcg

SEQ ID NO: 459620 - DNA, 391 bp, Homo sapiens
  misc_feature: HEFZJCU01EXTW0.48.77.G11.1.454.heavy.3.raw
agtatacatacacgaccggtgctcgatttagctagtcactcaagggaaaggggctggagtgggttggccgtgttaaaaccaaagctgagggtgggacaatagactacgctgcacccgtgacaggcagattcgccatctcaagagatgattcagaaggcacgctgtatctgcaaatgaacagcctgaaagccgaggacacagccgtgtattattgtaccgcagggctcggttactccgatactgactattggggccagggaaccctggtcaccgtctcctcagcctccaccaagggcccatcggtcttccccctggcgccctgctccaggagcacctccgagagcacagcggccctgggctgcctggtcaaggactacttcctatgtatact

SEQ ID NO: 459621 - DNA, 516 bp, Homo sapiens
  misc_feature: HEFZJCU01C1HK9.48.34.D01.1.454.heavy.3.raw
agtatacatacacgaccggtgctcgatttagatcgtctgtgttgggtttggggggaaaaggaagactgacggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaaggactactcctatgtata

SEQ ID NO: 459622 - DNA, 506 bp, Homo sapiens
  misc_feature: HEFZJCU01CTIZQ.10.38.D05.1.454.heavy.3.raw
  modified_base (390)..(390): a, c, t, g, unknown or other
catagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctntccagagacacttccaacaacatcttgtatcttcacatgcacaatctgagagtcgacgacacggccacctattattgtgcgcgacatgactacgctcaattctggggccagggacg

SEQ ID NO: 459623 - DNA, 511 bp, Homo sapiens
  misc_feature: HEFZJCU01CGA2K.22.36.D03.1.454.heavy.3.raw
acatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacaagtgaatctgcaaatgtacagcctcagcgccgaggacacggccgtctacttctgtgcgaagacctctattttggccgcggccgactactggggccga

SEQ ID NO: 459624 - DNA, 526 bp, Homo sapiens
  misc_feature: HEFZJCU01B0JIU.18.33.C11.1.454.heavy.3.raw
tacgagtatgcacgaccggtgctcgatttagagtgagctcgttgggtttgggggggagaggagcccagcactgggattccgaggtgtttccattcggtgatcagcactgaacacagaggactcaccatggagttttggctgagcgtggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttactgacccctggggccggggaacctggtcaccgtctccccacctccaccg

SEQ ID NO: 459625 - DNA, 498 bp, Homo sapiens
  misc_feature: HEFZJCU01AJ144.3.63.F08.1.454.heavy.3.raw
agacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaagggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagtttgttgggcgggatagcagcggacc

SEQ ID NO: 459626 - DNA, 432 bp, Homo sapiens; identical to SEQ ID NO: 444920
  misc_feature: HEFZJCU01CIB7J.11.39.D06.1.454.heavy.3.raw

SEQ ID NO: 459627 - DNA, 527 bp, Homo sapiens
  misc_feature: HEFZJCU01DUTKH.13.38.D05.1.454.heavy.3.raw
tcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctggggggggcttggttaagcctggggggtccctcagactctcctgtgcaacctctggattcattttctctgacgcctggttgagctgggtccgccaggctcccgggaaggggctggagtgggttggccgtattaaaggtagaagacatggtcggacaacagactacagtgttcccgtgaaaggcagattcactatctcaagagatgactcaaaagaaatgatatatctgcaaatgaacaacctgaaaagcgaggacacaggcgtgtattactgtaccacagatgggccagatgacaatggccgcgacgagttcgactactc

SEQ ID NO: 459628 - DNA, 523 bp, Homo sapiens; identical to SEQ ID NO: 452287
  misc_feature: HEFZJCU01DX6Y8.9.78.H01.1.454.heavy.3.raw

SEQ ID NO: 459629 - DNA, 506 bp, Homo sapiens
  misc_feature: HEFZJCU01B8PWQ.10.38.D05.1.454.heavy.3.raw
catagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaaatctgagagtcgacgacacggccacctattattgtgcgcgacatgactacgctcaattctggggccagggacg

SEQ ID NO: 459630 - DNA, 522 bp, Homo sapiens
  misc_feature: HEFZJCU01CA3NM.12.85.H08.1.454.heavy.3.raw
atacgacgtacacgaccggtgctcgatttagtatcactcagtcgcgggaggtctgagagaggagcccagccctgggattttcaggtgtcctcatttggtgatcaggactgaacagagagaactcaccatggagtttgggctgagctggctttttcttgtggctttttaaaaggtgcccagtgtgaggtgcaactgttggagtctgggggaggcttggtacagccggggggtccctgagactctcctgtgcagcctctggattcaattttaacagctttgccatgggctgggtccgccaggctccagggaaggggctggagtgggtctcgaatattaatgaaaggggtgataacacatactatgcggactctgtaaggggccggttcaccatctccagagacaattccaagaaaacactgtatctgcaattaaccagcctgagagtcgaggacacggccctttattactgtgcgaggatcgcccctatataggtggcgtggatcggggagtttggttctgggg

SEQ ID NO: 459631 - DNA, 432 bp, Homo sapiens; identical to SEQ ID NO: 444920
  misc_feature: HEFZJCU01D50CF.11.39.D06.1.454.heavy.3.raw

SEQ ID NO: 459632 - DNA, 519 bp, Homo sapiens
  misc_feature: HEFZJCU01DDFL1.3.55.E11.1.454.heavy.3.raw
agacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgatggaagaaaaaatattacgcagactccctgaagggtcgattcaccatctccagagacaattccaacaacaccctgtatttgcaaatgaacagcctgagaactgaagacacggctatctattactgtgcgagagatcagtccggacgacgaaaatgactacggtggtaaccttccagactactgggccagggaaccctggtcaccgtctcctcagcctccaccaagggccccatccggtcttccccctggccaccctcctcc

SEQ ID NO: 459633 - DNA, 515 bp, Homo sapiens
  misc_feature: HEFZJCU01B824N.12.55.E11.1.454.heavy.3.raw
atacgacgtacacgaccggtgctcgatttagcactcgcacgttgggtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccgccaggctccagggaaggggctggaatgggtggcagttatatcatatgatggaagctatcaatattacgcagattctgtgaagggccgactcaccatctccagagacaattccagaaacaaactgtatcttcaaataaacagtctgagacttgaggacacggctgtctattactgtgcgagagactacggtgaccttttctggtatttcgatctctggggccgtggcaccctggtcactgtctcctcggcttccaccaagggcccatcggtcttccccctggccgccctgctccaggagcacctcg

SEQ ID NO: 459634 - DNA, 525 bp, Homo sapiens
  misc_feature: HEFZJCU01C4RRB.11.25.C03.1.454.heavy.3.raw
cgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggcaagggaccac

SEQ ID NO: 459635 - DNA, 521 bp, Homo sapiens
  misc_feature: HEFZJCU01C8KA5.49.28.C06.1.454.heavy.3.raw
agtcgagagacacgaccggtgctcgatttagagctcacgtattgggtttggggacccaacaaccacatccctcctcagaagcccccagagcacaacgcctcaccatggactggacctggaggatcctctttttggtggcagcagccacaggtgcccactcccaggtccagcttgtgcagtccggggctgaggtgaagcggcctggggcctcagtgaaggtttcctgcaagacttctggatacaccttcggttcctacactatccattgggtgcgccaggcccccggacaaggccttgagtggatgggatggatcaactctgacaatggtagcagacaacattcaccgaagttccaggacagagtcaccattacccgagacacttccgcgaacacagcctacatggaactgagcggcctgagatttgaagacacggctgtgtattactgtgcgagagcaacggtcgtcatgggatttgactactggggccagggaaccccggtcaccgtctcctctgcctcc

SEQ ID NO: 459636 - DNA, 378 bp, Homo sapiens
  misc_feature: HEFZJCU01D7PZ3.47.77.G11.1.454.heavy.3.raw
agctcacgtacacgaccggtgctcgatttagctagtcactcaagggaaaggggctggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaaccctggtcaccgtctccacagcctccaccaagggcccatcggtcttccccctggcgccctgctccaggagcacctccgagagcacagcggccctgggctgcctggtcaaggactacttcctacgtgagct

SEQ ID NO: 459637 - DNA, 522 bp, Homo sapiens; identical to SEQ ID NO: 446788
  misc_feature: HEFZJCU01DMJL1.12.40.D07.1.454.heavy.3.raw

SEQ ID NO: 459638 - DNA, 499 bp, Homo sapiens
  misc_feature: HEFZJCU01EAOID.3.20.B09.1.454.heavy.3.raw
agacgcactccacgaccggtgctcgatttagtgtagtgtgaagggacagggtctccgaaggcttcaccagtcctggacctcctgtgcaagaacatgaaacatctgtggttcttccttctcctggtggcagctcccagatgggtcctgtcccaggtgcagctgcaagagtcgggcccaggactggtgaagccttcggagaccctgtccctcacctgcactgtctctggtggctccatccgtccttactactggagctggctccggcagcccccagggaagggactggagcatattgggtatgtctttcacagtggaggactgactacaacgcctccctcaggagtcgggtcaccatatcagtagacacgtccaagagccagttctccctgaagctgagggctgtgagcgccgcagacacggccgtgtattactgtgcgagactggccgcaacagactacggtggcaactcctatgcttttgatatctggggccaagggac

SEQ ID NO: 459639 - DNA, 436 bp, Homo sapiens; identical to SEQ ID NO: 444849
  misc_feature: HEFZJCU01DX96L.53.40.D07.1.454.heavy.3.raw

SEQ ID NO: 459640 - DNA, 472 bp, Homo sapiens
  misc_feature: HEFZJCU01AJU34.48.1.A01.1.454.heavy.3.raw
agtatacatacacgaccggtgctcgatttagacgtctcatcaaggaaggggggtccctgagactctcctgtgcaacctctggattcacattcactagatataccatgaactgggtccgccaggctccagcgaaggggctggagtgggtctcctccataagtagtggcagttcttacttacattacgcagactcagtgaagggccgattcgccatctccagagacaacgccaacaactcactgtttctgcagatggacaacctgagaggcgaggacacggctgtatattactgtgtctccccatacatcgcagctcgtggcacggactactggggccagggaaccctagtcaccgtctcctcagcctccaccaagggcccatcggtcttccccctggcgccctgctccaggagcacctccgagagcacagcggccctgggctgcctggtcaaggactacttcctatgtatact

SEQ ID NO: 459641 - DNA, 518 bp, Homo sapiens; identical to SEQ ID NO: 450435
  misc_feature: HEFZJCU01DFK6J.13.76.G10.1.454.heavy.3.raw

SEQ ID NO: 459642 - DNA, 508 bp, Homo sapiens
  misc_feature: HEFZJCU01BA1EX.19.26.C04.1.454.heavy.3.raw
  modified_base (503)..(503): a, c, t, g, unknown or other
tactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctcccagcctccaccaagggcccatcggtcttcccctggcgcctgctccngagca

SEQ ID NO: 459643 - DNA, 521 bp, Homo sapiens
  misc_feature: HEFZJCU01EU7DW.18.59.F04.1.454.heavy.3.raw
tacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccctgggccggggaaccctggtcaccgtctcccca

SEQ ID NO: 459644 - DNA, 526 bp, Homo sapiens
  misc_feature: HEFZJCU01C9UJW.12.40.D07.1.454.heavy.3.raw
atacgacgtacacgaccggtgctcgatttagtgatagagcgtaacaacagaggactcaccatggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgagggggccgattcaccatctccagagacaattacaagaacaccctttatctgcaaatagacagcctgagaccagacgacacggctgtctattattgcgcgagagagacacaacgaacctaactggccaatactatgggggcttgttctgggggccaggggaccctggtcatcgtctccccagcctccaccaagggcccatcggtcttcccctggccg

SEQ ID NO: 459645 - DNA, 529 bp, Homo sapiens; identical to SEQ ID NO: 446480
  misc_feature: HEFZJCU01AIQLN.18.33.C11.1.454.heavy.3.raw

SEQ ID NO: 459646 - DNA, 489 bp, Homo sapiens; identical to SEQ ID NO: 444791
  misc_feature: HEFZJCU01BJURC.47.85.H08.1.454.heavy.3.raw

SEQ ID NO: 459647 - DNA, 511 bp, Homo sapiens; identical to SEQ ID NO: 445840
  misc_feature: HEFZJCU01AWQFW.11.13.B02.1.454.heavy.3.raw

SEQ ID NO: 459648 - DNA, 379 bp, Homo sapiens; identical to SEQ ID NO: 444450
  misc_feature: HEFZJCU01C1Q9C.47.77.G11.1.454.heavy.3.raw

SEQ ID NO: 459649 - DNA, 519 bp, Homo sapiens
  misc_feature: HEFZJCU01CK8L1.9.70.G04.1.454.heavy.3.raw
tgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttattttaggaccagctgttaaaactcctactacggtctggacgtctggggccaggggacctaac
